United States Patent 11,931,406 (FLAVIVIRUS VACCINE) - sequence listing, part 12

SEQ ID NO: 6778 - RNA, 9876 nt, Artificial Sequence
  derived and/or modified CDS sequence (wt) from DENV-2__EU596489__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugggguuaacaugugcacccucauggccauagaccuuggugaauugugugaagauacaaucacguacaaguguccccuccucaggcaaaaugaaccagaagacauagauuguuggugcaacucuacguccacauggguaacuuauggaacauguaccaccacaggagaacacagaagggaaaaaagaucaguggcacucguuccacaugugggcaugggacuggagacacgaacugaaacauggaugucaucagaaggggccuggaaacacguucagagaauugaaaccuggaucuugagacauccagguuuuaccacaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauuaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguaggcaaugauacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaacuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugaucacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggacuuuggaucccugggaggaguguuuacaucuauaggaaaggcccuccaccaaguuuucggagcaaucuauggggcugcuuuuaguggggucucauggacuaugaaaauccucauaggaguuaucaucacauggauaggaaugaauucacguagcaccucacugucugugucacuaguauuggugggaaucgugacacuguacuuggggguuauggugcaggcugacacugguugcguugugagcuggaaaaauaaagaacugaaauguggcagcgggaucuucauuacagauaacgugcacacauggacagaacaauacaaguuccaaccagaauucccuucaaaacuagcuucagcuaucaagaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucacuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguaugggauggaaaucagaccauugaaagagaaagaggagaaucuggucaacuccuuggucacagccggacaugggcagauugauaacuuuucauuaggaguuuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagaaagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauuacuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucuuuggacuuuuccccuggaacgucaggaucuccaauugucgacagaaaaggaaaaguugugggucuuuacgguaaugguguuguuacaaggaguggagcauacgugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucauggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaagguggugcuuugauggaauuaagaacaaccaaauacuggaagaaaacguggaaguggaaaucuggacaaaagaaggggaaaggaagaaguuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagaguaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccugguccucugcgugacucaaguauuaaugaugaggacuacaugggcucugugugaggcucuaaccuuagcgacagggcccaucuccacacugugggaaggaaauccagggagguucuggaacacuaccauugcagugucaauggcuaacaucuuuagggggagcuacuuggccggagccggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaacuuuagcaaaagaaggcaucaaaagaggggaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauacaugcccucagucauagaaaaaauggaaacacuacaaaggaaauauggaggagccuuggugaggaauccacucucacgaaacuccacacaugagauguacuggguauccaaugccaccgggaacauagugucaucagugaacaugauuucaaggauguugauuaacagauucacaaugaaacacaagaaagccacuuacgagccagacguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagccuugggggcuauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacguuucuuagaguuugaagcccuaggauucuugaaugaagaucacugguucuccagagggaacucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaucaaaacaagguggugcguguacaaagaccaacaccaagaggcacaguaauggacaucauaucgagaaaagaccaaagaggcagcgggcaagucggcaccuauggccuuaauacuuuuaccaacauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcaugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcgaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6779 - RNA, 9876 nt, Artificial Sequence
  derived and/or modified CDS sequence (wt) from DENV-2__EU596490__SS-prME
acagccggcgugauuauuauguugauuccaacaguaauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaagugcccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggauauugagacauccaggcuuuaccauaauggcagcaauccuggcauauaccauaggaacgacacauuuccaaagggcucugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacacuaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaucugccguuaccauggcuacccggagcggacacacaaggaucaaauuggauacagaaagagacguuggucacuuucaaaaauccccacgcgaagaaacaggacgucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacagugaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucagugacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaauucgcuggaaguugaagacuaugguuuuggaguuuuuuccacaaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucgcacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugugaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuacuaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacacacacugaccauacuaaucagaacggguuugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagcuuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaacuaauaccggaaccauaggcgccgugucucuggacuuuuccccuggaacgucaggaucuccaauugucgacagaaaaggaaaaguugugggucuuuacgguaaugguguuguuacaaggaguggagcauaugugagugccauagcccagaccgaaaaaagcauugaagacaauccagagaucgaagaugacauuuuccgaaagaaaagauugaccaucauggaucuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcucacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcggguuaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguaucgggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacacagcauugaaaauuccucagugaaugucucccuaacagccauugcuaaccaagccacagugcuaaugggucuugggagaggauggccauugucaaagauggacgucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcagugucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauugcugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaagcacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaauucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagagaucgcugugcagaacugguuagcaagaguggggcgugaaagguuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccagauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6780 - RNA, 9876 nt, Artificial Sequence
  derived and/or modified CDS sequence (wt) from DENV-2__EU596491__SS-prME
acagcaggcgugauuauuauguugauuccaacagugauggcguuccauuuaaccacacgcaauggagaaccacacaugaucguugguaggcaggagaaagggaaaagucuccuguucaaaacagaggaugguguuaacauguguacccucauggccauagaccuuggugaauugugugaagacacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacauaguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaacuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacaauggagugcucuccgagaacgggccucgacuucaaugagauggugcugcugcagauggaagacaaagcuuggcuggugcacaggcaaugguuccuagaccugccguuaccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacggggcaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccaugcaagaucccuuuugagauaacagauuuggaaaaaagacacgucuuaggacgccugauuacagucaacccaaucguaacagaaaaagaugccccagucaacauagaagcagaaccuccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuguggugcaggcagauagugguugcguugugagcuggaaaaauaaagaacugaaauguggcagcgggaucuucaucacagauaacguacacacauggacagaacaauacaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaagggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccgaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaggaaaacuuggucaacuccuuggucacagccggacaugggcagauugacaacuuuucacuaggagucuugggaauggcacuguuccuggaagaaaugcuuaggacccgaguaggaacgaaacaugcaacacugcuaguugcacuaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugaugguccucaaaauagugagaaauauggaaaaauaccaauuggcagugacuaucauggccauuucgugugucccaaaugcagugauauugcaaaacgcauggaaagugaguugcacaauauuggcagcgguguccguuucuccacugcuccuaacauccucacagcagaaagcggauuggauaccacuggcauugacgauaaaaggucucaauccaacagccauuuuucuaacaacucucucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagaucggagccggaguuuacaaagaaggaacauuucauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauauguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagcagguauuuucaugacagccacuccuccgggaagcagagacccauuuccucagagcaaugcaccaaucauagaugaggagagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccguugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaagggcgcacaaucaugcucucagugaacugccggagacccuggagacacugcuucuacugacacuccuggcaacagucacaggaggaauuuucuuauucuuaaugagcggaaaagguauagggaagaugacucugggaauguguugcauaaucacagcuagcauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuacugguagcacauuaugcuauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugugugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaauacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaauauggucacaccggaagggaaggugguggaucuugguugcggcagagggggcuggucauacuauugugggggacuaaagaauguaagagaagucaaaggccuaacaaaaggaggaccaggacacgaggaacccauccccaugucaacauauggguggaaucuagugcgucugcaaagugguguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguccucaacccauauaugcccucagucauagagaaaauggaaacacuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaagcaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucggcaccuauggccuuaauacuuucaccaauauggaagcccaauuaauuagacagauggaaggagaaggaaucuucaaaagcauucagcaccugaccgccacagaagaaaucgcuguacagaacuggcuagcaagaguggggcgugaaaggcuaucaagaauggccaucaguggagaugacuguguuguaaaacccauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggccuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaacauccagacagcaauaaaucaagucagaucccuuauaggcaaugaggaauacacagacuacaugccauccaugaagagauucagaagggaagaggaagaggcagguguccugugguag

SEQ ID NO: 6781 - RNA, 9876 nt, Artificial Sequence
  derived and/or modified CDS sequence (wt) from DENV-2__EU677141__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguuguccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaagaugucguuguuuuagggucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagauacgucuuaggucgccugauuacaguuaacccaaucguaacaggaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucucugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaauugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacaacuacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagacuauucuugaacugacugaugcguuagccuugggcaugaugguccucaaaauagugagaaauauggaaaaguaccaauuggcagugacuaucauggcuaucuugugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggaggacuucuuacuguguguuacgugcucacuggacgaucggccgacuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacgcguggugcuguucugaugcauagagggaagaggauugaaccaucaugggcagaugucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaauggaguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagcuauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacguuuacuaugaggcugcuaucaccagucagagugccaaauuacaaccugaucaucauggacgaagcccacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaagcccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaguugaccuacguagucauagccauccucacagugguggccgcaaccauggcaaaugagauggguuuccuggaaaaaaccaagaaagaccucggauugggaagcauuauaacccaggaaucugagagcaacauccuggacauagaucuacguccugcaucagcauggacgcuguaugccguggcuacaacauuugucacaccaauguugagacauagcaucgaaaauuccucagugaaugucucccuaacagccauugcuaaccaggccacagugcuaaugggucuugggagaggauggccauugucaaagauggacaucggaguuccccuccuugccauuggaugcuauucacaagucaacccuauaacucucacagcagcccuucuuuugcugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacccaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacuaaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagacaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacauuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcaccugacagucacagaagaaaucgcuguacagaacuggcuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccauggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6782 - RNA, 9876 nt, Artificial Sequence
  derived and/or modified CDS sequence (wt) from DENV-2__EU677144__SS-prME
acagcaggcaugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagacuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacgacaacagaaucucguuguccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggauuaaauuggauacagaaagagacauuggucacuuucaaaaauccccacgcgaagaaacaagaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaagagauacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucucugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaauugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaaaucacacacccucuggagcaauggaguauuagaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacaacuacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagacuauucuugaacugacugaugcguuagccuugggcaugaugguccucaaaauagugagaaauauggaaaaguaccaauuggcagugacuaucauggcuaucuugugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacuacucuuucgagaaccagcaagaaaaggagcuggccgcuaaaugaagcugucauggcagucgggauggugagcauucuagccaguucucuccuaaagaaugacauucccaugacagguccauuaguggcuggaggacuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccaauggaaaaagccgaacuggaagauggagccuauagaaucaagcaaagagggauuuuuggauauucucagauuggagccggaguuuacaaagaaggaacauuccauacaauguggcacgucacgcguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaauggaguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagcuauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacguuuacuaugaggcugcuaucaccagucagagugccaaauuacaaccugaucaucauggacgaagcccacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaaccgacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaguugaccuacguagucauagccauccucacagugguggccgcaaccauggcaaaugagauggguuuccuggaaaaaaccaagaaagaccucggauugggaagcauuauaacccaggaaucugagagcaacauccuggacauagaucuacguccugcaucagcauggacgcuguaugccguggcuacaacauuugucacaccaauguugagacauagcaucgaaaauuccucagugaaugucucccuaacagccauugcuaaucaggccacagugcuaaugggucuugggagaggauggccauugucaaagauggacaucggaguuccccuccuugcuauuggaugcuauucacaagucaacccuauaacucucacagcagcccuucuuuugcugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacccaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucacgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguagacacgagaacccaagaaccgaaggaaggcacaaagaaacuaaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugcgaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacauuagaagacuuaaaaaaugaggaaaugguaacaaaccacaugaaaggagaacacaagaaacuagccgaggccauauuuaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcaccugacagucacagaagaaaucgcuguacggaacuggcuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaacccucaagaggauggaacgauuggacacaagugccuuucuguucacaccauuuucaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucgcauuggguuccaacaagucgaacaaccugguccauacacgcuaagcaugaauggaugacgacggaagacaugcuggcagucuggaacaggguuuggauccaagaaaacccauggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6783 - RNA, 9876 nt, Artificial Sequence
  derived and/or modified CDS sequence (wt) from DENV-2__EU677145__SS-prME
acagcaggcgugauuguuauguugauuccaacagcgauggcguuccauuuaaccacacgcaauggagaaccacacaugaucguugguaggcaggagaaagggaaaagucuucuguucaaaacagaggauggugucaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgaugcauaggaauaucaaauagagacuucguagaagggguuucaggaggaagcuggguugacauagucuuagaacauggaaguugugugacaacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggagaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucguacagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacuauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcuaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaaucgugaaagaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucauaacagaaaaagauagcccagucaacauagaagcagaaccuccauucggagacagcuacaucaucauaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaccaaguuuucggagcaaucuauggggcugccuuuaguggggucucauggacuaugaaaauccucauaggggucaucaucacauggauaggaaugaauucacguagcaccucacugucugugucgcuaguauuggugggagucgugacacuguaccugggagccauggugcaggcugauagugguugcguugugagcuggaaaaauaaagagcugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagagaaugaaguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucgcuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaguuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccaugccagagaccauucuugaacugacugaugcguuagccuugggcaugaugguccucaaaauagugagaaauauggaaaaauaccaauuggcagugacuaucauggcuauuucgugugucccaaaugcagugauauugcaaaacgcauggaaggugaguugcacaauauuggcaacgguguccguuucuccacugcucuuaacauccucacagcagaaagcggauuggauaccacuggcauugacuauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaaucccagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagacugaccaucauggaccuccauccaggagcaggaaagacaaaaagauaccuuccagccauaguuagagaagccauaaaacguggcuugagaacauugauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuaggaaaaauggaaagaaagugauacaacucagcaggaagacuuuugacucugaguauguuaagacuagagccaaugauugggacuuuguggucacaacugacauuucagaaaugggugccaacuucaaggcugagaggguuauagacccuagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacagaguggcagcugaaggcaucaacuacgcagacagaaagugguguuuugauggaauuaagaacaaccaaauacuggaagaaaacguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacagcuagcauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccauuuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaacccuagcaaaagaaggcaucaaaagaggagaaacggaccaccaugccgugucacgaggaucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccgucccuaugucaacauauggguggaaucuagugcgucugcaaagugggguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguccucaacccauauaugcccucagucauagaaaaaauggaaacacuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaagcaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacaccacuccauuuggacaacagcgcguuuucaaagagaaaguggacacgagaacucaagaaccgaaggaaggcacaaagaaacugaugaaaauuacagcagaguggcuuuggaaagaacuaggaaagaaaaagacaccuaggauguguaccagagaagaauucacaaaaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaacauggaagcccaauuaauuagacagauggagggggaaggaaucuucaaaagcauucagcaccugacagccacagaagaaaucgcuguacagaacugguuagcaagaguggggcgugaaaggcuaucaagaauggccaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauuggcagagcccgaauuucccagggagccggguggucuuugaaggagacggccuguuuggggaagucuuacgcccaaauguggacccugauguacuuccauagacgugaccucagacuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccagacagcaauaaaucaagucagaucccuuauaggcaaugaggaauacacagacuacaugccauccaugaagagauucagaagggaagaggaagaggcagguguccugugguag

SEQ ID NO: 6784 - RNA, 9876 nt, Artificial Sequence
  derived and/or modified CDS sequence (wt) from DENV-2__EU677146__SS-prME
acaguaggcgugauuguuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcggugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggucucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacagucaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucauugucugugucacuaguauuggugggagucgugacacuguacuuggggguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugaggcaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacuacuagucgcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauuacaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcaucuuagccaguucucuccuaaagaaugacauuccuaugacagguccauuaguggcuggagggcuucuuacuguguguuacgugcucacuggacgaucggccgauuuggaacuggagagagcugccgaugugaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcuccuacuagaguuguggcagcugaaauggaggaagcucuuagaggacuuccaauaagauaccaaaccccagccauuagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaaccgacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccccuggaaaaugaugaagacugugcacauuggaaagaagccaaaaugcucuuagauaacaucaacacaccugaaggaaucauuccuagcauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaaucaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggccaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccggaaaagugugacacauuguugugugacauaggggaaucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauugggauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaaucacggcagaguggcuuuggaaagaacuaggaaagaaaaagacacccaggauguguaccagagaagaauuuacaagaaagguaagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaauugcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6785 - RNA, 9876 nt, Artificial Sequence
  derived and/or modified CDS sequence (wt) from DENV-2__EU687214__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagacuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaaaaacauggaaggaaaaguugugcugccagaaaaucuggaauacaccaucgugauaacgccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucgucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggacccuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugaggaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguucaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguggagaugggugaagcagccgggauuuucaugacagccacuccuccgggaaguagagacccauuuccucagagcaaugcaccaaucauggaugaggaaagagaaaucccugagcgcucguggaauucaggucaugaaugggucacgaacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggcuacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagaugggcuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacgugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacucagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagaugugagcaagaaggaagggggagcaauguacgccgaugacacagcaggaugggacacgagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaauauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaauagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccugucuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6786 - RNA, 9876 nt, Artificial Sequence
  derived and/or modified CDS sequence (wt) from DENV-2__EU687215__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagacuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucgucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggacccuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugauauagguaugggagugacuuaccuugcccuacuagcagccuucaaaguuagaccaacuuuugcagcuggacuacucuugaggaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagaugguagcaugucgauaaaaaaugaagaggaagaacauacacuaaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguucaaacgaaaccuggacuuuucaaaaccaaaaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguggagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggcuacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagaugggcuuccuggaaaaaaccaagaaagaccucggauugggaagcauuacaacccaggaaucugagagcaacauucuggacauagaucuacguccugcaucagcauggacgcuguaugccguggcuacagcauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguggcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacgugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacucagaguccucaacuuaguggaaaauugguugaacaauaacacccaauuuugcguaaagguucucaacccauauaugcccucagucauagagaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuaugagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagaugugagcaagaaggaagggggagcaauguacgccgaugacacagcaggaugggacacgagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaauauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccugucuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6787 - RNA, 9876 nt, Artificial Sequence
  derived and/or modified CDS sequence (wt) from DENV-2__EU687216__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccaggcuuuaccauaauggcagcaauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacggaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaacggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggcaaggaaaucaaaauaacaccacagaguuccaccacagaagcagagcugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaaccuccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucaucacagauaacguacacacauggacagaacaauauaaguuccaaccagaauccccuucaaaacuagcuucagcuauccaaaaagcccaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuaggcaagcuugagauggacuuuaauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaggaaaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugaugguccucaaaauagugagaaauauggaaaaauaccaauuagcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaacccggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacgugguuugagaacauuaauccuggcucccacuagagucguggcagcugaaauggaggaagcucuuaggggacuuccaauaagauaccaaaccccagccaucagagccgagcacaccgggcgggagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccaccccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugacugggacuuuguggucacaacugacauuucagaaaugggugccaacuucaaggcugagaggguuauagacccuagacguugcaugaaaccaguuauacuaacagauggcgaagagcgagugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaacuaaugagaagaggggacuuaccagucugguuggccuacaaaguggcagcagaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaagggcguacaaucaugcucucagugaacugccggagacccuggagacacugcuucuacugacacuccuggcaacagucacaggaggaaucuucuuauucuuaaugagcggaaaagguguagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuuaucacaccaauguugcgacauagcauugaaaauuccucaguaaaugucucccuaacagccauugcuaaccaagcuacagugcuaaugggucuugggaaaggauggccauugucaaagauggacauaggaguuccccuccuugccauuggaugcuacucacaagucaacccuauaacccucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaucaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaagugggguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaaaacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucggcaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaacauccagacagcaauaaaucaagucagaucccuuauaggcaaugaggaauacacagacuacaugccauccaugaagagauucagaagggaagaggaagaggcagguguccugugguag

SEQ ID NO: 6788 - RNA, 9876 nt, Artificial Sequence
  derived and/or modified CDS sequence (wt) from DENV-2__EU726770__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaagugcccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauauaccauaggaacgacacauuuccaaagggcucugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggacgucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacagugaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacgcagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaauucgcuggaaguugaagacuaugguuuuggaguuuuuuccacaaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugugaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuacuaugacggaugacauaggcaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacggguuugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugccauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaucaaaccccagccaucagagccgagcacaccgggcgggagaucguggaccuaaugugccaugccacauuuacuaugaggcugcuaucaccagucagagugccaaauuacaaccugaucaucauggacgaagcccacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcaucacaacccaggaaucugagagcaacauucuggacauagaucuacguccugcaucagcauggacgcuguaugccguggcuacaacauuugucacaccaauguugagacacagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcagugucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaauucccugaguggaguggaaggagaagggcugcacaagcuaggcuacauuuuaagagaugugagcaagaaggaagggggaacaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcugugcagaacugguuagcaagaguggggcgugaaagguuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaagagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6789 - RNA, 9876 nt, Artificial Sequence
  derived and/or modified CDS sequence (wt) from DENV-2__EU781135__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagacuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauucuacugacagccgucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacacuaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcagcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuugcggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugcgacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggacccuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaauugcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcuaucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguucaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguggagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguagucauagccauccucacagugguggccgcaaccauggcaaaugagaugggcuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaagggaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagcgggcaagucggcaccuauggccucaauacuuucaccaauauggaagcccaauuaauuagacagauggaaggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagccagaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6790 - RNA, 9876 nt, Artificial Sequence
  derived and/or modified CDS sequence (wt) from DENV-2__EU687222__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaaucacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6791 - RNA, 9876 nt, Artificial Sequence
  derived and/or modified CDS sequence (wt) from DENV-2__EU687223__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacaggaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacguggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagccuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaaucacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6792 - RNA, 9876 nt, Artificial Sequence
  derived and/or modified CDS sequence (wt) from DENV-2__EU687227__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugaguugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggacccaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcgaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauuggcugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucauccauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaaucacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagaaaugguaacaaaccagaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6793 - RNA, 9876 nt, Artificial Sequence
  derived and/or modified CDS sequence (wt) from DENV-2__EU687228__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacugcauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaugaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauagugguugcguugugagcuggaaaaauaaagaacugaaauguggcagcgggaucuucauuacagauaacgugcacacauggacagaacaauauaaguuccaaccagaaucccccucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguaucaaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaaucacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6794 - RNA, 9876 nt, Artificial Sequence
  derived and/or modified CDS sequence (wt) from DENV-2__EU687230__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccaugcaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguggcaccucacugucugugucacuaguauuggugggagucgugacacuguacuuggggguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6795 - RNA, 9876 nt, Artificial Sequence
  derived and/or modified CDS sequence (wt) from DENV-2__EU687231__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguuuuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguagaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaauuccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugaguggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaauauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaaucacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggguggaacgauuggacacaagugccuuucuguucacaccauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaguggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6796 - RNA, 9876 nt, Artificial Sequence
  derived and/or modified CDS sequence (wt) from DENV-2__EU687199__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaacuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagaugauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucugucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucgcacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucacgaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaccuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccauggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6797 - RNA, 9876 nt, Artificial Sequence
  derived and/or modified CDS sequence (wt) from DENV-2__EU687235__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagacuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagauucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuugcggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggacccuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccacuagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguucaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguggagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagaugggcuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaauauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6798 - RNA, 9876 nt, Artificial Sequence
  derived and/or modified CDS sequence (wt) from DENV-2__EU687236__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguugucuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcaaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagcuaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagaaagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccggaaaaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagccugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuggugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaaaaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggagucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6799 - RNA, 9876 nt, Artificial Sequence
  derived and/or modified CDS sequence (wt) from DENV-2__EU687237__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagaguaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6800 - RNA, 9876 nt, Artificial Sequence
  derived and/or modified CDS sequence (wt) from DENV-2__EU687238__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaccaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccaucaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcagugucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagaguaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccaucauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6801 - RNA, 9876 nt, Artificial Sequence
  derived and/or modified CDS sequence (wt) from DENV-2__EU687240__SS-prME
acaguaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauaguuuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugaucacagucaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugaggcaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacuguuagucgcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauuacaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcaucuuagccaguucucuccuaaagaaugacauuccuaugacagguccauuaguggcuggagggcuucuuacuguguguuacgugcucacuggacgaucggccgauuuggaacuggagagagcugccgaugugaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcuccuacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaaccgacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaaucaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucaaaaaagaacagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggccaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccggaaaagugugacacauuguugugugacauaggggaaucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauugggauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacuguugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaaucacggcagaguggcuuuggaaagaacuaggaaagaaaaagacacccaggauguguaccagagaagaauuuacaagaaagguaagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagaaaugguaacaaaccauaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaauugcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6802 - RNA, 9876 nt, Artificial Sequence
  derived and/or modified CDS sequence (wt) from DENV-2__EU687241__SS-prME
acagcaggcgugauuauuauguugauuccaacagcaauggcguuccauuuaaccacacguaauggagaaccacacaugaucguugguaggcaagagaaagggaaaagccuucuguucaaaacagaggauggcguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacuccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugacaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguauucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaacuauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagacgacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccuaaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacuaccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagaguaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuucuaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucgucaccuauggccuuaauacuuucaccaacauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6803 - RNA, 9876 nt, Artificial Sequence
  derived and/or modified CDS sequence (wt) from DENV-2__EU687242__SS-prME
acagcaggcgugauuauuauguugauuccaacagcaauggcguuccauuuaaccacacguaauggagaaccacacaugauaguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauauaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuagaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugcuacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcagaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucggaauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguucaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguggagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucaaugaacugccggagacccuggagacacugcuuuuacugacacuccuggccacagucacaggaggaaucuucuuauucuuaaugagcggaaaagguauagggaagaugacccugggaauguguuguauaaucacggcuagcauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagaugggcuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaaaaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcuaacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaauauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaaguuagaucccuuauaggcaaugaggaauacacagacuacaugccauccaugaaaagauucagaaaggaagaggaagaggcagguguccugugguag

SEQ ID NO: 6804 - RNA, 9876 nt, Artificial Sequence
  derived and/or modified CDS sequence (wt) from DENV-2__EU687243__SS-prME
acagcaggcgugauuauuauguugauuccaacagcaauggcguuccauuuaaccacacguaauggagaaccacacaugauaguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauauaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuagaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucggaauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguucaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguggagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuugccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucaaugaacugccggagacccuggagacacugcuuuuacugacacuccuggccacagucacaggaggaaucuucuuauucuuaaugagcggaaaagguauagggaagaugacccugggaauguguuguauaaucacggcuagcauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagaugggcuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaaaaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcuaacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaauauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6805 - RNA, 9876 nt, Artificial Sequence
  derived and/or modified CDS sequence (wt) from DENV-2__EU687245__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauauaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccugguuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauuuggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucguaacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuucauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguucaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaagcauagcagcuagaggauauauuucaacucgaguggagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucaaugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagaugggcuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaagugaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaaugcaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaaaaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccauccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaucaagaggcacaguaauggacaucauaucgagaaaagaccaaagaggcagcgggcaagucggcaccuauggccuuaauacuuucaccaauauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccugcuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgguaaaucaagucagaucccuuauaggcaaugaggaauacacagacuacaugccauccaugaaaagauucagaaaggaagaggaagaggcagguguccugugguag

SEQ ID NO: 6806 - RNA, 9873 nt, Artificial Sequence
  derived and/or modified CDS sequence (wt) from DENV-2__HQ541798__SS-prME
acugcaggcaugaucuuuaugcugauuccaacagugauggcguuccauuuaaccacacguaacggagaaccacacaugaucgucaguagacaagagaaagggaaaagucuucuguuuaaaacaggggauggugugaacauguguacccucauggccauggaccuuggugaauugugugaagauacaaucacguacaaguguccucuucucaggcagaaugaaccagaagacauagauuguuggugcaacucuacguccacauggguaacuuaugggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacagaagccaaacaaucugccacucuaaggaaguacuguauagaggcaaagcugaccaacacaacaacagaaucucgcugcccaacacaaggagaacccagccuaaaugaagagcaggacaaaagguucgucugcaaacacuccaugguggacagaggauggggaaauggauguggauuauuuggaaaaggaggcauugugaccugugcuauguucacaugcaaaaaggacaugaaaggagaagucgugcaaccagaaaacuuggaauacaccauugugauaacaccucacucaggggaagagcaugcagucggaaaugacacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaaaauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacuuacuguucacaggacaucucaagugcaggcugaggauggacaaacuacagcucaaaggaaugucauacucuaugugcacaggaaaguuuaaaguugugaaggaaauagcagaaacacaacauggaacaauaguuaucagaguacaauaugaaggggaugguucuccauguaagaucccuuuugagauaauggauuuggaaaaaagacauguuuuaggucgccugauuacagucaacccaaucguaacagaaaaagauagcccagucaacauagaagcagaaccuccauucggagacagcuacaucaucauaggaguagagccgggacaauugaagcucaacugguuuaagaaaggaaguucuaucggccaaaugcuugagacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggacuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaguguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcggccccagcccacugagcugaaguauucauggaaaacauggggcaaagcgaaaaugcucucuacagagucucauaaccagaccuuucuaauugauggccccgaaacagcagaaugccccaacacaaacagagcuuggaauucgcuggaaguugaagacuauggcuuuggaguauucaccaccaauauauggcuaaaguugagagaaaagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagccacacacccucuggaguaaugaagugcuagaaagugagaugauaauuccaaagaauuucgcuggaccagugucacaacacaacuacagaccaggcuaccauacacaaacagcaggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugacgcguuagccuugggcaugaugguccuuaaaauggugagaaaaauggaaaaguaucaauuggcagugacuaucauggcuaucuugugcgucccaaaugcagugauauuacaaaacgcauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaacuaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuguaucacuaccaaucacggcagcagcaugguaccugugggaagugaagaaacaacgggcuggaguauugugggaugucccuucacccccacccguaggaaaggcugaacuggaagauggagccuauagaaucaagcaaaaagggauucuuggauauucccagaucggagccggaguuuacaaagaaggaacauuccauacaauguggcaugucacacgcggcgcuguucuaaugcauaaaggaaagaggauugaaccaucaugggcggacguuaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaaguauugaagacaauccagagaucgaagaugacauuuuucgaaagagaaaauugaccaucauggaccuccacccaggagcgggaaagacgaagagauaccuuccggccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuuuacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaaaagcaggaaaugauauagcagcuugccugagaaaaaauggaaagaaagugauacaacucaguaggaagaccuuugauucugaguaugucaagacuagaaccaaugauugggacuucguggucacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagauugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugagccuaaucacagaaauggguaggcuuccaacuuucaugacucagaaggcaagagacgcacuggacaacuuagcagugcugcacacggcugaagcagguggaagggcguacaaucaugcucucagugaacugccggagacccuggagacauugcuuuuacugacacuucuggcuacagucacgggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacugucgauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccaucgcagugucaauggcuaacauuuuuagagggaguuacuuggccggagcuggacuucucuuuuccaucaugaagaacacaaccaacacgagaaggggaacuggcaacauaggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugccuucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuacgagccagauguagaccucggaagcggaacccgcaacaucggaauugaaagugagauaccaaaccuagacauaaucgggaaaagaauaaaaauaaaacaagagcaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagauacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaguucggcaaggcaaaagguagcagagccauaugguacauguggcuuggagcacgcuucuuagaguuugaagcccuaggauucuugaaugaagaucacugguucuccagagagaacuccuugaguggaguggaaggagaagggcugcacaagcuagguuacauuuuaagagacgugagcaagaaagagggaggagcaauguaugccgaugacaccgcaggaugggacacaagaaucacacuggaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaagcauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacucguaguuccauguagaaaccaagaugaacugauugguagagcccgaauuucccaaggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacagcggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucagguuagaucccuuauaggcaaugaggaauacacagauuacaugccauccaugaaaagauucagaagagaagaggaagaggcaggaguccugugguag

SEQ ID NO: 6807 - RNA, 9876 nt, Artificial Sequence
  derived and/or modified CDS sequence (wt) from DENV-2__JF730053__SS-prME
acugcaggcaugaucauuaugcugauuccaacagugauggcguuccauuuaaccacacguaacggagaaccacacaugaucgucaguagacaagagaaagggaaaagucuucuguuuaaaacaggggauggugugaacauguguacccucauggccauggaccuuggugaauugugugaagauacaaucacguacaaguguccucuucucaggcagaaugaaccagaagacauagauuguuggugcaacucuacguccacauggguaacuuaugggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacagaagccaaacaaucugccacucuaaggaaguacuguauagaggcaaagcugaccaacacaacaacagaaucucgcugcccaacacaaggagaacccagccuaaaugaagagcaggacaaaagguucgucugcaaacacuccaugguggacagaggauggggaaauggauguggauuauuuggaaaaggaggcauugugaccugugcuauguucacaugcaaaaagaacaugaaaggaaaagucgugcaaccagaaaacuuggaauacaccauugugauaacaccucacucaggggaagagcaugcagucggaaaugacacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaaaauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacuuacuguucacaggacaucucaagugcaggcugaggauggacaaacuacagcucaaaggaaugucauacucuaugugcacaggaaaguuuaaaguugugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacagaaaaagauagcccagucaacauagaagcagaaccuccauucggagacagcuacaucaucauaggaguagagccgggacaauugaagcucaacugguuuaagaaaggaaguucuaucggccaaaugcuugagacaacaaugaggggagcgaagagaauggccauuuuaggugacacagcuugggauuuuggaucccugggaggaguguuuacaucuauaggaaaggcucuccaccaagucuucggagcaaucuauggggcugccuucaguggggucucauggacuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaguguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcggccccagcccacugagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaaaagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggaguaaugaagugcuagaaagugagaugauaauuccaaagaauuucgcuggaccagugucacaacacaacuacagaccaggcuaccauacacaaacagcaggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugacgcguuagccuugggcaugaugguccuuaaaauggugagaaaaauggaaaaguaucaauuggcagugacuaucauggcuaucuugugcgucccaaaugcagugauauuacaaaacgcauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaacuaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuguaucacuaccaaucacggcagcagcaugguaccugugggaagugaagaaacaacgggcuggaguauugugggaugucccuucacccccacccguaggaaaggcugaacuggaagauggagccuauagaaucaagcaaaaagggauucuuggauauucccagaucggagccggaguuuacaaagaaggaacauuccauacaauguggcaugucacacgcggcgcuguucuaaugcauaaaggaaagaggauugaaccaucaugggcggacguuaagaaagaccuaauaucauauggaggaggcuggaagcuagaaggagaauggaaggaaggagaagaaguccaggucuuggcauuggagccugguaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaaguauugaagacaauccagagaucgaagaugacauuuuucgaaagagaaaauugaccaucauggaccuccacccaggagcgggaaagacgaagagauaccuuccggccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaaaagcaggaaaugauauagcagcuugccugagaaaaaauggaaagaaagugauacaacucaguaggaagaccuuugauucugaguaugucaagacuagaaccaaugauugggacuucguggucacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagauugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugagccuaaucacagaaauggguaggcuuccaacuuucaugacucagaaggcaagagacgcacuggacaacuuagcagugcugcacacggcugaagcagguggaagggcguacaaucaugcucucagugaacugccggagacccuggagacauugcuuuuacugacacuucuggcuacagucacgggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacugucgauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccaucgcagugucaauggcuaacauuuuuagagggaguuacuuggccggagcuggacuucucuuuuccaucaugaagaacacaaccaacacgagaaggggaacuggcaacauaggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaauccuacgguagaagcaggacgaacacucagaguccuuaacuuaguggaaaauugguugaacaacaacacccaauuuugcauaaagguucucaacccauacaugccuucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuacgagccagauguagaccucggaagcggaacccgcaacaucggaauugaaagugagauaccaaaccuagacauaaucgggaaaagaauagaaaaaauaaaacaagagcaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguauaacaugaugggaaaaagagagaagaagcuaggggaguucggcaaggcaaaagguagcagagccauaugguacauguggcuuggagcacgcuucuuagaguuugaagcccuaggauucuugaaugaagaucacugguucuccagagagaacuccuugaguggaguggaaggagaagggcugcacaagcuagguuacauuuuaagagacgugagcaagaaagagggaggagcaauguaugccgaugacaccgcaggaugggacacaagaaucacacuagaagaucuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaagcauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccaaggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacagcggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6808 - RNA, 9876 nt, Artificial Sequence
  derived and/or modified CDS sequence (wt) from DENV-2__EU529706__SS-prME
acagcaggcgugauuauuauguugauuccaacagcaauggcguuccauuuaaccacacguaauggagaaccacacaugaucguugguaggcaagagaaagggaaaagucuucuguuuaaaacagaggaugguguuaacaugugcacccucauggccauagaccuuggugaauugugugaagauacaaucacguacaagugcccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauauaccauaggaacgacacauuuccaaagggcucugaucuucauuuuacugacagccguugcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaagggaggcauugugaccugugcuauguucacaugcaaaaagaacauggaaggaaaagucgugcagccagaaaaucuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacguuggucacuuucaaaaauccccacgcgaagaaacaggacgucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacagugaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuauuaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaauucgcuggaaguugaagacuaugguuuuggaguuuuuuccacaaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaucuagguaagcuugagauggacuuugaucucugugaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuauuucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcaguugggauggugagcauuuuagccaguucucuccuaaagaaugacauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacggguuugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugccauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuucuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauucuggacauagaucuacguccugcaucagcauggacgcuguaugccguggcuacaacauuugucacaccaauguugagacacagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacccucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcagugucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgguagaagcaggacgaacacuuagaguccucaacuuaguggaaaauugguugaacaauaacacccaauuuugcguaaagguucucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaggaagaagacacccaggauguguaccagagaagaauuuacaagaaaggugagaagcaaugcagccuugggggccauauucacugaugagaacaaauggaaaucggcacgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaauucccugaguggaguggaaggagaagggcugcacaagcuaggcuacauuuuaagagaugugagcaagaaggaagggggagcaauguacgccgaugacacagcaggaugggacacaagaauuacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaacaccuucaccaacauggaagcccaauuaauuagacagauggagggagaaggaauuuuuaaaagcauucagcgccugacagucacagaagaaaucgcugugcagaacugguuagcaagaguggggcgugaaagguuaucaagaauggccaucaguggagaugacugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6809 - RNA, 9876 nt, Artificial Sequence
  derived and/or modified CDS sequence (wt) from DENV-2__EU482720__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugggguuaacaugugcacccucauggccauagaccuuggugaauugugugaagacacaaucacguacaaguguccccuccucaggcaaaaugaaccagaagacauagauuguuggugcaacuccacguccacauggguaacuuauggaacauguaccaccacaggagaacacagaagggaaaaaagaucaguggcacucguuccacaugugggcaugggacuggagacacgaacugaaacauggaugucaucagaaggggccuggaaacacguucagagaauugaaaccuggaucuugagacauccaggcuuuaccacaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguugggucgacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaagggggcauuguaaccugugcuauguucacaugcaaaaagaacauggaaggaaaaguugugcugccagaaaaucuggaauacaccaucgugauaacaccucacucaggagaagagcacgcuguaggcaaugauacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaacuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugaucacaguuaacccaaucgcaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcccuccaccaaguuuucggagcaaucuauggggcugcuuuuaguggggucucauggacuaugaaaauccucauaggaguuaucaucacauggauaggaaugaauucacguagcaccucacugucugugucacuaguauuggugggaaucgugacacuguacuuggggguuauggugcaggcugacacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucacuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuuuugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggaguuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagaaagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauuacuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaagguggugcuuugauggaauuaagaacaaccaaauacuggaagaaaacguggaaguggaaaucuggacaaaagaaggggaaaggaagaaauuaaaacccagaugguuggaugcuaggaccuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagaguaacauucuggacauagaucuacguccugcaucagcauggacgcuguaugccguggccacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccugguccucugcgugacucaaguauuaaugaugaggacuacaugggcucugugugaggcucuaaccuuagcgacagggcccaucuccacacugugggaaggaaauccagggagguucuggaacacuaccauugcagugucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaacuuuagcaaaagaaggcaucaaaagaggggaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacucaauuuugcguaaagguucucaacccauacaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagcuacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguauauguggcuuggagcacguuucuuagaguuugaagcccuaggauucuugaaugaagaucacugguucuccagagggaauucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaucaaaacaagguggugcguguacaaagaccaacaccaagaggcacaguaauggacaucauaucgagaaaagaccaaagaggcagcgggcaagucggcaccuauggccuuaauacuuuuaccaacauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcaugcucguggucccaugcagaaaccaagaugaacugauugguagagcccgaauuucccagggagccggguggucuuugaaggagacggccuguuuggggaagucuuaugcccaaauguggaccuugauguacuuccacagacgugaccucagacuggcggcgaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6810 - RNA, 9876 nt, Artificial Sequence
  derived and/or modified CDS sequence (wt) from DENV-2__EU482721__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugggguuaacaugugcacccucauggccauagaccuuggugaauugugugaagauacaaucacguacaaguguccucuccucaggcaaaaugaaccagaagacauagauuguuggugcaacuccacguccacauggguaacuuauggaacauguaccaccacaggagaacacagaagggaaaaaagaucaguggcacucguuccacaugugggcaugggacuggagacacgaacugaaacauggaugucaucagaaggggccuggaaacacguucagagaauugaaaccuggaucuugagacauccaggcuuuaccacaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguugggucgacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugaucacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcccuccaccaaguuuucggagcaaucuauggggcugcuuuuaguggggucucauggacuaugaaaauccucauaggaguuaucaucacauggauaggaaugaauucacguagcaccucacugucugugucacuaguauuggugggaaucgugacacuguacuuggggguuaugguacaggcugacacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcugaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugacaacuuuucauuaggagucuugggaauggcucuguuccuggaagaaaugcucaggacccgaauaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucaccauugcucuuaacauccucacaacagaaagcggauuggauaccauuggcauugacgauaaaaggucucaauccaacagccauuuuucuaacaacucucucgagaaccagcaagaaaaggagcuggccgcuaaaugaagcuaucauggcagucgggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauuacuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucaaauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgauagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagagggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaagguggugcuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugaggcagguggaagggcuuacaaucaugcucucagugaacugccagagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagaguaacauucuggacauagaucuacguccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaauccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucagaucuacaagaaaaguggaauccaggaaguggauagaacucuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacuuagaguccucaacuuaguggaaaauuggcugaacaauaacacucaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacacccaggauguguaccagagaagaauucacaagaaaagugagaagcaaugcagccuugggggccauauucacugaugagaacaaauggaaaucggcucgugaggcuguugaagaugguagguuuugggagcugguugacagggaaagaaaucuucaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaucaaaacaagguggugcguguacaaagaccaacaccaagaggcacaguaauggacaucauaucgagaaaagaccaaagaggcagcgggcaagucggcaccuauggccuuaauacuuuuaccaacauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcaugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcgaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6811 - RNA, 9876 nt, Artificial Sequence
  derived and/or modified CDS sequence (wt) from DENV-2__EU482722__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauagugguuguguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagaguugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaacuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaucaauugaccuacguagucauagccauccucacagugguggccgcgaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacucaauuuugcguaaagguucucaacccauacaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagcuacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguuaucccuauggugacacagauggcaaugacagacacgacuccauuuggacaacaacgcguuuucaaagagaaaguggacacgagaacccaagaaccgaaggaaggcacaaagaaacugaugagaaucacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6812 - RNA, 9876 nt, Artificial Sequence
  derived and/or modified CDS sequence (wt) from DENV-2__EU482723__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggauuggagacacgaacugaaacauggaugucaucagaaagggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguuguguaacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggauaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccaccauaggaaucgcacuccuuucucaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggaguuuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagaggaaagaggauagaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggagaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacaugggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaaccggaucagcaucaucuauggugaacggaguuguuaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6813 - RNA, 9876 nt, Artificial Sequence
  derived and/or modified CDS sequence (wt) from DENV-2__EU482724__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagacuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauucuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuugcggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaagcagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggacccuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggauuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguucaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguggagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagaugcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguaucaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagaugggcuuccuggaaaaaaccaagaaagaccuuggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaagggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuacaucuugaagggaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaauauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagccagaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6814 - RNA, 9876 nt, Artificial Sequence
  derived and/or modified CDS sequence (wt) from DENV-2__EU482725__SS-prME
acagcaggcgugauuauuauguugauuccaacagcaauggcguuccauuuaaccacacguaauggagaaccacacaugaucguugguaggcaagagaaagggaaaagucuucuguuuaaaacagaggaugguguuaacaugugcacccucauggccauagaccuuggugaauugugugaagauacaaucacguacaagugcccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauauaccauaggaacgacacauuuccaaagggcucugaucuucauuuuacugacagccguugcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggacgucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacagugaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaauucgcuggaaguugaagacuaugguuuuggaguuuuuuccacaaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugugaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuacuaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacggguuugcuggugaucucaggagucuuuccaguaucgauaccaauuacagcagcagcaugguaccugugggaagugagaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccgggaccauaggcgccguaucucuggacuuuuccccuggaacgucaggaucuccaauugucgacagaaaaggaaaaguugugggucuuuacgguaaugguguuguuacaaggaguggagcauaugugagugccauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacggucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacacagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacccucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcagugucaauggcuaacaucuuuagggggagcuacuuggccggagcuggacuccucuuuuccaucaugaagaacacaacaaauacaagaagaggaacuggcaacauaggagagacacuuggagaaaaauggaaaagccaauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaagcacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaauucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauaccuucaccaacauggaagcccaauuaauuagacagauggagggagaaggaauuuuuaaaagcauucagcgccugacagucacagaagaaaucgcugugcagaacugguuagcaagaguggggcgugaaagguuaucaagaauggccaucaguggagaugacugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6815 - RNA, 9876 nt, Artificial Sequence
  derived and/or modified CDS sequence (wt) from DENV-2__EU482726__SS-prME
acagcaggcgugauuguuauguugauuccaacagugauggcguuccauuuaaccacacgcaauggagaaccacacaugaucguugguaggcaggagaaagggaaaagucuccuguucaaaacagaggaugguguuaacauguguacccucauggccauagaccuuggugaauugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacauaguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaacuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacaauggagugcucuccgagaacgggccucgacuucaaugagauggugcugcugcagauggaagacaaagcuuggcuggugcacaggcaaugguuccuagaccugccguuaccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguauaggaaaguuuaaaaucgugaaggaaauagcagaaacacaacauggaacaauaguuaucagaguacaauaugaaggggacgguucuccaugcaagaucccuuuugagauaacagauuuggaaaaaagacacgucuuaggacgccugauuacagucaacccaaucguaacagaaaaagaugccccagucaacauagaagcagaaccuccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuguggugcaggcagauagugguugcguugugagcuggaaaaauaaagaacugaaauguggcagcgggaucuucaucacagauaacguacacacauggacagaacaauacaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaagggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaggaaaacuuggucaacuccuuggucacagccggacaugggcagauugacaacuuuucacuaggagucuugggaauggcacuguuccuggaagaaaugcuuaggacccgaguaggaacgaaacaugcaacacugcuaguugcacuaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugaugguccucaaaauagugagaaauauggaaaaauaccaauuggcagugacuaucauggccauuucgugugucccaaaugcagugauauugcaaaacgcauggaaagugaguugcacaauauuggcagcgguguccguuucuccacugcuccuaacauccucacagcagaaagcggauuggauaccacuggcauugacgauaaaaggucucaauccaacagccauuuuucuaacaacucucucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagaucggagccggaguuuacaaagaaggaacauuucauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauauguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcucacuucacggacccagcaaguauagcugcuagaggauauaucucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguaucgggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacacagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcagugucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauugcugugugacauaggggaaucgucaccaaaucccacgauagaagcaggacgaacacuuagaguccucaacuuaguggaaaauugguugaacaauaacacccaauuuugcauaaagguccucaacccauauaugcccucagucauagaaaaaauggaaacacuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaagcaagagcaugaaacaucauggcauuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucggcaccuauggccuuaauacuuucaccaauauggaagcccaauuaauuagacagauggaaggagaaggaaucuucaaaagcauucagcaccugaccgccacagaagaaaucgcuguacagaacuggcuagcaagaguggggcgugaaaggcuaucaagaauggccaucaguggagaugacuguguuguaaaacccauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggccuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaacauccagacagcaauaaaucaagucagaucccuuauaggcaaugaggaauacacagacuacaugccauccaugaagagauucagaagggaagaggaagaggcagguguccugugguag

SEQ ID NO: 6816 - RNA, 9876 nt, Artificial Sequence
  derived and/or modified CDS sequence (wt) from DENV-2__EU482727__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaaugcauggaaggugaguugcacaauauuggcagcgguguccguuucuccauugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuaccguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggccggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagcugagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagauugugcauauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcaaaccaagccacagugcuaaugggucucgggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguuaauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccaggaggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6817 - RNA, 9876 nt, Artificial Sequence
  derived and/or modified CDS sequence (wt) from DENV-2__EU482728__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuucucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauagggacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacucccugguagacagaggauggggaaauggauguggauuauuuggaaaaggaggcauugugaccugugcuauguuuacauguaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuauuagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaagggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguacuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucggaauggugagcauuuuagccaguucucuccuaaagaaugacauucccaugacagguccauuaguggcuggagggcuucuuacuguguguuacgugcucacuggacggucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauuguugacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucucugacccugaaccuaaucacagaaaugggcaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauuuuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaguauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacaucggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaacacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuccaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6818 - RNA, 9876 nt, Artificial Sequence
  derived and/or modified CDS sequence (wt) from DENV-2__EU482729__SS-prME
acagcaggcgugauuauuauguugauuccaacagcaauggcguuccauuuaaccacacguaauggagaaccacacaugaucguugguaggcaagaaaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccguugcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaagaaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguucgagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagaaauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaauagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaauugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacugcuccugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaaugcauggaaggugaguugcacaauauuggcagcgguguccguuucuccauugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggccggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacgcguggugcuguucugaugcauagagggaagaggauugaaccaucaugggcagacgucaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacgugguuugagaacauuaauccuggcucccacuagaguuguggcagcugaaauggaggaagcucuuagaggacuuccaauaagauaccaaaccccagccaucagagcugagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcauauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugacuuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcaaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacacaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccaggaggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucucagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6819 - RNA, 9876 nt, Artificial Sequence
  derived and/or modified CDS sequence (wt) from DENV-2__EU482731__SS-prME
acagcaggcgugauuguuauguugauuccaacagugauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacauaguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaacuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacaauggagugcucuccgagaacgggccucgacuucaaugagauggugcugcugcagauggaagacaaagcuuggcuggugcacaggcaaugguuccuagaccugccguuaccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacagucaacccaaucguaacagaaaaagaugccccagucaacauagaagcagaaccuccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauacaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaagggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaggaaaacuuggucaacuccuuggucacagccggacaugggcagauugacaacuuuucacuaggagucuugggaauggcacuguuccuggaagaaaugcuuaggacccgaguaggaacgaaacaugcaacacugcuaguugcacuaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugaugguccucaaaauagugagaaauauggaaaaauaccaauuggcagugacuaucauggccauuucgugugucccaaaugcagugauauugcaaaacgcauggaaagugaguugcacaauauuggcagcgguguccguuucuccacugcuccuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuucauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauauguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagcagguauuuucaugacagccacuccuccgggaagcagagacccauuuccucagagcaaugcaccaaucauagaugaggagagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaagggcgcacaaucaugcucucagugaacugccggagacccuggagacacugcuucuacugacacuccuggcaacagucacaggaggaauuuucuuauucuuaaugagcggaaaagguauagggaagaugacucugggaauguguugcauaaucacagcuagcauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugcuauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaauauggucacaccggaagggaaggugguggaucuugguugcggcagagggggcuggucauacuauugugggggacuaaagaauguaagagaagucaaaggccuaacaaaaggaggaccaggacacgaagaacccaucccuaugucaacauauggguggaaucuagugcgucugcaaagugguguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucagucauagaaaaaauggaaacacuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaagcaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucggcaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaacccauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggccuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaacauccagacagcaauaaaucaagucagaucccuuauaggcaaugaggaauacacagacuacaugccauccaugaagagauucagaagggaagaggaagaggcagguguccugugguag

SEQ ID NO: 6820 - RNA, 9876 nt, Artificial Sequence
  derived and/or modified CDS sequence (wt) from DENV-2__EU482732__SS-prME
acaguaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuagauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggagcguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguguuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaucugggaagagugaugguuauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagagaauugaaccaucaugggcagacgucaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacggcaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcucccaacuuuuaugacucagaaggcaagagacgcacuggacaacuuagcugugcugcauacggcugagguaggaggaagggcguacaaucaugcccucagugaacugccggagacccuggagacacugcuuuuacugacacuccuggccacagucacaggaggaaucuucuuauucuuaaugagcggaaaagguauagggaagaugacccugggaauguguuguauaaucacagcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuauuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacugaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaacacuuucaccaacauggaagcccaauuaaucagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggacccuuauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggcuaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6821 - RNA, 9876 nt, Artificial Sequence
  derived and/or modified CDS sequence (wt) from DENV-2__EU482733__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuucucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauagggacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaagggaaucaugcaggcaggaaaacgaucuuugcggccccagcccacugagcugaaguacucauggaaaacauggggaaaggcgaaaaugcucuccacagagucucacaaucagaccuuccuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguacuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucggaauggugagcauuuuagccaguucucuccuaaagaaugacauucccaugacagguccauuaguggcuggagggcuucuuacuguguguuacgugcucacuggacggucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauuguugacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucucugacccugaaucuaaucacagaaaugggcaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagugacaggaggaaucuucuuauuuuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacaucggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacuguugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaacacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuccaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6822 - RNA, 9876 nt, Artificial Sequence
  derived and/or modified CDS sequence (wt) from DENV-2__EU482734__SS-prME
acagcaggcgugauuguuauguugauuccaacagcgauggcguuucauuuaaccacacgcaauggagaaccacacaugaucguugguaggcaggagaaaggaaaaagucuucuguucaaaacagaggauggugucaacauguguacccucauggccauagaccuuggugaauugugugaagauacaaucacguacaaguguccucuccucagacaaaaugaaccagaagacauagauuguuggugcaacucuacguccacauggguaacuuaugggacauguaccacuacaggggaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucucguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucgugcagccagaaaauuuggaauacaccaucaugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcugguacacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcauacggcacucacaggggccacagaaauccagaugucaucaggaaacuuacuguucacaggacaucucaagugcaggcugagaauggacaaacuacagcucaaaggaaugucauacucuaugugcacaggaaaguuuaaaauugugaaggaaauagcagaaacacaacauggaacaauaguuaucagaguacaauaugaaggggacgguucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggauuuuggaucccugggaggaguguuuacaucuguaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuauaccugggagcuauggugcaggcugauagugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucucugcggccccagcccacugagcugaaguacucauggaaaacauggggaaaggcgaaaaugcucucuacagagucucacaaucagaccuuucuuauugauggcccugaaacagcagaaugccccaacacaaacagagcuuggaacucgcuggaagucgaagacuaugguuuuggaguuuuuaccaccaauauauggcuaaaauugagagaaaaacaggauguauuuugugacucaaaacucaugucagcggccauuaaagacaacagagccguccaugcugauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuaggcaagcuugagauggacuuugauuucugcgaaggaacuacagugguggugacugaggacuguggaaauagaggaccuucuuuaagaacgaccacugccucuggaaaacucauaacagaauggugcugccgauccuguacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggugcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcucuccuuucccaaagcaccauaccagagaccauucuugaacugacugaugcguuagccuugggcaugauggcucucaaaauagugaaaaauauggaaaaguaccaauuggcagugacuaucauggccauuucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacgacucuuucgagaaccagcaagaaaaggagcuggccgcuaaaugaagcuaucauggcaguugggauggugagcauuuuagccaguucucuccugaagaaugauauucccaugacagguccauuaguggcuggagggcuccuuacaguauguuacgugcucacuggacgaucggccgauuuggaacuagagagagcugccgauguaaaaugggaagaucaggcagaaauaucaggaagcagcccaauccugucaauaacaauaucagaagauggcagcaugucgauaagaaaugaagaggaagaacaaacacugaccauacucaucagaacgggauuguuggugaucucaggagucuuuccaguaucgauaccaguuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaguaucauauggaggaggcuggaagcuagaaggagaauggaaggaaggagaggaaguccaaguccuggcauuagaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagaaaucgaagaugacauuuuccgaaagaaaagauugaccaucauggaccuucauccaggagcaggaaagacaaaaagauaccuuccagccauaguuagagaagccauaaaacguggcuugagaacauuaauccuggcucccaccagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugaucaucauggacgaagcccacuucacagacccagcaagcauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggauuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugacgaagacugugcacauuggaaagaagccaaaaugcuccuagauaacaucaacacacccgaaggaaucauuccuaguauguucgaaccagagcgugaaaaaguggaugccauugauggugaauaccguuugagaggagaagcaaggaaaaccuucguggaccuaaugagaagaggggacuuaccagucugguuagccuacaaaguggcagcugaaggcaucaacuacgcagacagaaggugguguuuugauggaauuaagaauaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagccgggagaaaaucuuugacccugaaucuaaucacagaaauggguaggcuuccaacuuucaugacucagaaggcaagaaacgcacuggacaacuuggcugugcugcauacggcugaggcagguggaaaggcguauaaucaugcucucagugaacugccggagacccuggagacacugcuucuacuaacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaacauccuggacauagaucuacguccugcaucagcauggacgcuguaugccguggccacaacauuugucacaccaauguugaggcauagcauugaaaauuccucagugaaugucucccuaacagccauugcuaaccaagcuacagugcuaaugggucuugggaaaggauggccauugucaaagauggacaucggaguuccccuccucgccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaacccuggcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccaucaccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaauccauauaugcccucagucauagaaaaaauggaaacacuacaaaggaaauauggaggagccuuagugaggaauccacucucacgaaacuccacgcaugagauguacuggguaucuaaugccacugggaacauagugucaucagugaacaugauuucaaggauguugauuaacagauucacaaugaaacacaagaaagccaccuacgagccggauguugaccugggaaguggaacucgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacccaagaaccgaaggaaggcacaaagaaacugaugaaaauuacggcagaguggcuuuggaaagaacuaggaaagaaaaagacacccaggauguguaccagagaagaauucacaagaaaggugagaagcaaugcagccuugggggccauauucacugaugagaacaaauggaaaucggcacgugaggcuguugaagaugguagguuuugggagcugguugacagggaaagaaaucuccaucuugaaggaaagugugagacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaagcuagccgaggccauauucaaauuaacguaccaaaacaaaguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagucacagaagaaaucgcuguacagaacuggcuagcaagaguggggcgugaaaggcuaucaagaauggccaucaguggagaugauuguguuguaaaacccauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccaaggagccggguggucuuugaaggagacggccuguuuggggaagucuuacgcccaaauguggacccugauguacuuccacagacgugaccucagacuggcggcaaaugccauuugcucggcagucccgucacauuggguuccaacgagucgaacaaccugguccauacacgcuaagcaugaauggaugacgacggaggacaugcuggcagucuggaacaggguguggauccaagaaaacccguggauggaagacaaaacuccaguggaaucaugggaagaagucccauacuuggggaaaagagaagaccaaugguguggcucauugauugggcuaacaagcagggcuaccugggcaaagaacauccaaacagcaauaaaccaagucagaucccuuauaggcaaugaggaauacacagacuacaugccauccaugaagagauucagaagggaagaggaagaggcagguguccugugguag

SEQ ID NO: 6823 - RNA, 9876 nt, Artificial Sequence
  derived and/or modified CDS sequence (wt) from DENV-2__EU482735__SS-prME
acagcaggcgugauuguuauguugauuccaacagcgauggcguuucauuuaaccacacgcaauggagaaccacacaugaucguugguaggcaggagaaaggaaaaagucuucuguucaaaacagaggauggugucaacauguguacccucauggccauagaccuuggugaauugugugaagauacaaucacguacaaguguccucuccucagacaaaaugaaccagaagacauagauuguuggugcaacucuacguccacauggguaacuuaugggacauguaccacuacaggggaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucucguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucgugcagccagaaaauuuggaauacaccaucaugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcugguacacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcauacggcacucacaggggccacagaaauccagaugucaucaggaaacuuacuguucacaggacaucucaagugcaggcugagaauggacaaacuacagcucaaaggaaugucauacucuaugugcacaggaaaguuuaaaauugugaaggaaauagcagaaacacaacauggaacaauaguuaucagaguacaauaugaaggggacgguucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggauuuuggaucccugggaggaguguuuacaucuguaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuauaccugggagcuauggugcaggcugauagugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucucugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaagucgaagacuaugguuuuggaguuuuuaccaccaauauauggcuaaaauugagagaaaaacaggauguauuuugugacucaaaacucaugucagcggccauuaaagacaacagagccguccaugcugauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuaggcaagcuugagauggacuuugauuucugcgaaggaacuacagugguggugacugaggacuguggaaauagaggaccuucuuuaagaacgaccacugccucuggaaaacucauaacagaauggugcugccgauccuguacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggugcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcucuccuuucccaaagcaccauaccagagaccauucuugaacugacugaugcguuagccuugggcaugauggcucucaaaauagugaaaaauauggaaaaguaccaauuggcagugacuaucauggccauuucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacgacucuuucgagaaccagcaagaaaaggagcuggccgcuaaaugaagcuaucauggcaguugggauggugagcauuuuagccaguucucuccugaagaaugauauucccaugacagguccauuaguggcuggagggcuccuuacaguauguuacgugcucacuggacgaucggccgauuuggaacuagagagagcugccgauguaaaaugggaagaucaggcagaaauaucaggaagcagcccaauccugucaauaacaauaucagaagauggcagcaugucgauaagaaaugaagaggaagaacaaacacugaccauacucaucagaacgggauuguuggugaucucaggagucuuuccaguaucgauaccaguuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaguaucauauggaggaggcuggaagcuagaaggagaauggaaggaaggagaggaaguccaaguccuggcauuagaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagaaaucgaagaugacauuuuccgaaagaaaagauugaccaucauggaccuucauccaggagcaggaaagacaaaaagauaccuuccagccauaguuagagaagccauaaaacguggcuugagaacauuaauccuggcucccaccagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugaucaucauggacgaagcccacuucacagacccagcaagcauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggauuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugacgaagacugugcacauuggaaagaagccaaaaugcuccuagauaacaucaacacacccgaaggaaucauuccuaguauguucgaaccagagcgugaaaaaguggaugccauugauggugaauaccguuugagaggagaagcaaggaaaaccuucguggaccuaaugagaagaggggacuuaccagucugguuagccuacaaaguggcagcugaaggcaucaacuacgcagacagaaggugguguuuugauggaauuaagaauaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagccgggagaaaaucuuugacccugaaucuaaucacagaaauggguaggcuuccaacuuucaugacucagaaggcaagaaacgcacuggacaacuuggcugugcugcauacggcugaggcagguggaaaggcguauaaucaugcucucagugaacugccggagacccuggagacacugcuucuacuaacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaacauccuggacauagaucuacguccugcaucagcauggacgcuguaugccguggccacaacauuugucacaccaauguugaggcauagcauugaaaauuccucagugaaugucucccuaacagccauugcuaaccaagcuacagugcuaaugggucuugggaaaggauggccauugucaaagauggacaucggaguuccccuccucgccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaacgaugaggacuacaugggcuuugugcgaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaacccuggcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaauccauauaugcccucagucauagaaaaaauggaaacacuacaaaggaaauauggaggagccuuagugaggaauccacucucacgaaacuccacgcaugagauguacuggguaucuaaugccacugggaacauagugucaucagugaacaugauuucaaggauguugauuaacagauucacaaugaaacacaagaaagccaccuacgagccggauguugacuugggaaguggaacucgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacccaagaaccgaaggaaggcacaaagaaacugaugaaaauuacggcagaguggcuuuggaaagaacuaggaaagaaaaagacacccaggauguguaccagagaagaauucacaagaaaggugagaagcaaugcagccuugggggccauauucacugaugagaacaaauggaaaucggcacgugaggcuguugaagaugguagguuuugggagcugguugacagggaaagaaaucuccaucuugaaggaaagugugagacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaagcuagccgaggccauauucaaauuaacguaccaaaacaaaguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagucacagaagaaaucgcuguacagaacuggcuagcaagaguggggcgugaaaggcuaucaagaauggccaucaguggagaugauuguguuguaaaacccauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccaaggagccggguggucuuugaaggagacggccuguuuggggaagucuuacgcccaaauguggacccugauguacuuccacagacgugaccucagacuggcggcaaaugccauuugcucggcagucccgucacauuggguuccaacgagucgaacaaccugguccauacacgcuaagcaugaauggaugacgacggaggacaugcuggcagucuggaacaggguguggauccaagaaaacccguggauggaagacaaaacuccaguggaaucaugggaagaagucccauacuuggggaaaagagaagaccaaugguguggcucauugauugggcuaacaagcagggcuaccugggcaaagaacauccaaacagcaauaaaccaagucagaucccuuauaggcaaugaggaauacacagacuacaugccauccaugaagagauucagaagggaagaggaagaggcagguguccugugguag

SEQ ID NO: 6824 - RNA, 9876 nt, Artificial Sequence
  derived and/or modified CDS sequence (wt) from DENV-2__EU482736__SS-prME
acagcaggcgugauuauuauguugauuccaacagcgauggcguuccauuuaaccacacguaauggagaaccacacaugaucguugguaggcaagagaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucguuccacauguggguaugggacuggagacacgaacugaaacauggaugucaucggaaggggccuggaaacauguucagagaauugaaaccuggaucuugagacauccaggcuuuaccauaauggcagcaauccuggcauacaccauaggaacaacacauuuccaaagggccuugauuuucaucuuacugacggccgucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucguguugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucauuaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucagugacaagauuggagaaucugauguggaaacaaauaacaccagaauugaaucacauucuaucagaaaaugagguaaaguugaccauuaugacaggagacaucaaaggaaucaugcaggcaggaaaacgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguuguaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcaccauaccagagaccauucuugaacugacugacgcguuagccuugagcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaggccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggauuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuggauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauagcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccggaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugacuuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6825 - RNA, 9876 nt, Artificial Sequence
  derived and/or modified CDS sequence (wt) from DENV-2__EU482737__SS-prME
acagcaggcgugauuguuauguugauuccaacagcgauggcguuccauuuaaccacacguaauggagaaccacacaugaucguugguaggcaagagaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucguuccacauguggguaugggacuggagacacgaacugaaacauggaugucaucggaaggggccuggaaacauguucagagaauugaaaccuggaucuugagacauccaggcuuuaccauaauggcagcaauccuggcauacaccauaggaacgacacauuuccaaagggccuugauuuucaucuuacugacggccgucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucguguugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucauuaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucagugacaagauuggagaaucugauguggaaacaaauaacaccagaauugaaucacauucuaucagaaaaugagguaaaguugaccauuaugacaggagacaucaaaggaaucaugcaggcaggaaaacgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguuguaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcaccauaccagagaccauucuugaacugacugacgcguuagccuugagcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaggccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccuuuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucucaggaaaaauggaaagaaagugauacaacucaguaggaagacuuuugauucugaguauguuaagacuagagccaaugauugggauuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuggauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauagcuaaccaagccacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccggaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugacuuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcucaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6826 - RNA, 9876 nt, Artificial Sequence
  derived and/or modified CDS sequence (wt) from DENV-2__EU482739__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguucuaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuugcuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggaccaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagaccauucuugaacugacugaugcguuagccuugggcaugaugguccucaaaauagugagaaaucuggaaaaguaccaauuggcagugacuaucauggcuaucucgugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagacggaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuaugcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcauacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaccuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccauaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcaccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6827 - RNA, 9876 nt, Artificial Sequence
  derived and/or modified CDS sequence (wt) from DENV-2__EU482740__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuucaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauaguccuagaacauggaaguugugugacgacgauggcaaagaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauucggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcaaagaaacaggaugucguuguuuuaggaucucaagaaggggccaugcacacggcacucacaggagccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaacgacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcagccaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagccgccauaaaagacaacagagccguccaugccgacauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugugaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuuaggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugauauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccauaccagagaccauucuagaacugacugaugcguuagccuugggcaugaugguccucaagauagugagaaauauggaaaaguaccaauuggcagugacuaucauggcuaucucgugugucccaaaugcagugauauugcaaaacgcauggaaggugaguugcacaauauuggcagugguguccguuucuccacugcuuuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaagaagaacaaacacugacuauacucauuagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggagucuacaaagaaggaacauuccauacaauguggcacgucacacguggugcuguccugaugcauagagggaagaggauugaaccaucaugggcagacgucaagaaggaccuaauaucauauggaggaggcuggaaacuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugacuaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaagcauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagagagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccaguuugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaauuacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaaaaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuaccuggccggagcuggacuucucuuuuccaucaugaagaacacaacaaacacaagaagaggaacugguaacauaggagagacacuuggagaaaaauggaaaagccgauuaaacgcacuggggaaaagugaauuucagaucuacaagaaaaguggaauccaggaaguggauagaaccuuagcaaaagaaggcauaaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacuaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaacacuuucaccaacauggaagcccaauuaauuagacagauggagggggaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcgaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuugggaaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6828 - RNA, 9876 nt, Artificial Sequence
  derived and/or modified CDS sequence (wt) from DENV-2__EU482741__SS-prME
acagcaggcgugauuauuauguugauuccaacagcgauggcguuccauuuaaccacacguaauggagaaccacacaugaucguugguaggcaagagaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucguuccacauguggguaugggacuggagacacgaacugaaacauggaugucaucggaaggggccuggaaacauguucagagaauugaaaccuggaucuugagacauccaggcuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucauuaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucagugacaagauuggagaaucugauguggaaacaaauaacaccagaauugaaucacauucuaucagaaaaugagguaaaguugaccauuaugacaggagacaucaaaggaaucaugcaggcaggaaaacgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguuguaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcaccauaccagagaccauucuugaacugacugacgcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccaguggaaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgcuguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggauuuuguggucacaacugacauuucagaaaugggugccaacuucaaggcugaaaggguuauagaccccagacguugcaugaaaccagucauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuggauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauagcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccggaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugacuuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaauuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaacacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6829 - RNA, 9876 nt, Artificial Sequence
  derived and/or modified CDS sequence (wt) from DENV-2__EU482742__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccccagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaauugccggagacccuggagacacugcuuuuacugacacuccuggccgcagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacccucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagacguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacucaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucgcauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6830 - RNA, 9876 nt, Artificial Sequence
  derived and/or modified CDS sequence (wt) from DENV-2__EU482744__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguagacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaaccacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaauaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaagcugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaggacaacagagccguccaugccgauauggguuauuggauagaaagugcacucaaugacacauggaagauggagaaagccucuuucauugaaguuaaaagcugccacuggccaaagucacacacucucuggagcaauggaguauuggaaagugagaugauaauuccaaaaaauuuugcugggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacagaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugaguaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgacuuggaacuggagagagcugccgauguaaaaugggaagaucaggcagaaauaucaggaagcagcccaauccugucaauaacaauaucagaagauggcagcaugucgauaaaaaaugaagaggaagaacaaacacugacuauacucaucagaacgggauuguuggugaucucaggagucuuuccaguaucgauaccaaucacggcagcagcaugguauuugugggaagugaagaaacaacgggcuggaguauugugggacgucccuucacccccaccagugggaaaagccgaacuggaagauggagccuauagaaucaagcaaagagggauucuuggauauucccagauuggagcuggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcucacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucuuagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguagccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacauuuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaucuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacguugucccuauggugacacagauggcaaugacagacacgacuccauuuggacaacaacgcguuuucaaagagaaaguggacacgagaacccaagaaccgaaggaaggcacaaagaaauugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacguuucuuagaguuugaagcccuaggauucuugaaugaagaucacugguucuccagagggaacucccugaguggaguggaaggagaagggcugcacagacuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaacauggaagcccaauuaauuagacagauggagggagaaggaauuuucaaaagcauucagcaccugacaguuacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguauuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauuaauugggcuaacaagcagggcuaccugggcuaagaacauccaaacagcaauaaaucaagucagaucccuuauaggcaaugaggaauacacagacuacaugccaucuaugaagagauucagaaaggaagaggaagaggccgguguccugugguag

SEQ ID NO: 6831 - RNA, 9876 nt, Artificial Sequence
  derived and/or modified CDS sequence (wt) from DENV-2__EU482745__SS-prME
acagcaggcgugauuauuauguugauuccaacagcgauggcguuccauuuaaccacacguaauggagaaccacacaugaucguugguaggcaagagaaggggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacuuuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccccacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccuaauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaacucacguagcaccucacugucugugucacuaguauuggugggagucgugacacuguaccugggagcuauggugcaggcugauagugguugcguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucggaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaagguaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuucgcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucagggagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaaccaaggaaucugagagcaacauccuggacauagaucuacguccugcaucagcauggacguuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucaaaucccuuauaggcaaugaggaauacacagacuacaugccauccaugaagagauucagaagggaagaggaagaggccgguguccugugguag

SEQ ID NO: 6832 - RNA, 9876 nt, Artificial Sequence
  derived and/or modified CDS sequence (wt) from DENV-2__EU482746__SS-prME
acagcaggcgugauuauuauguugauuccaacagcgauggcguuccauuuaaccacacguaauggagaaccacacaugaucguugguaggcaagagaaggggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuacgggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccuaauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucggaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaagguaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugauggucauggugggcgcuaccaugacggaugacauagguaugggagugacuuaucuugcccuacuagcagcuuucaaaguuagaccaacuuucgcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacguuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6833 - RNA, 9876 nt, Artificial Sequence
  derived and/or modified CDS sequence (wt) from DENV-2__EU482590__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuuuaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaaccacagaaucucguugcccaacacaaggggagcccagucuaaaugaagagcaggacaaaagguucgucugcaaacacuccaugguggacagaggauggggaaauggauguggauuauuuggaaagggaggcauugugaccugugcuauguucacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccguuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaauaaagaacugaaauguggcagcgggaucuucauaacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagccucacaaucagaccuuucuuauugauggcccugaaacagcagaaugccccaacacaaacagagcuuggaacucgcuggaaguugaagacuaugguuuuggaguuuuuaccaccaacauauggcuaaaacugagagaaaaacaggauguauuuugugacucaaaacucaugucagcggccauaaaggacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugacuucugcgaaggaaccacagugguggugacugaggacugcggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauaggcaugggagugacuuaucuugcccuacuagcagcuuucaaaguuagaccaacuuuugcagcuggacuacuccugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugacuauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagauaauccagaaaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguagcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaauccuggaugaggaaagagaaaucccugagcguucguggaauucaggacaugaaugggucacggauuuuaaagggaagacuguaugguuuguuccaaguauaaaagcaggaaaugacauagcagcuugucuuaggaagaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcucauuggaaagaagcuaaaaugcuucuagacaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccgcuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuucuggccacagucacaggaggaaucuucuuauucuuaaugagcggaaaaggcauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaaccccccaagacaaccaauugaccuacguugucauagccauccucacagugguagccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaauaucucccuaacagcuauugcuaaccaagccacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaggcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaauugagaugguucgucgagagaaauauggucacaccagaagggaaggugguggaccucgguugcggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaaaguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaucuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugaucgacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuaugcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuagcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccaucuaugaagagauucagaagggaagaggaagaggccgguguccugugguag

SEQ ID NO: 6834 - RNA, 9876 nt, Artificial Sequence
  derived and/or modified CDS sequence (wt) from DENV-2__EU482594__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggacuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggucucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaagacauggggaaaagcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugaaaaaacugaccuccaaggaauuaaugauggccaccauaggaaucgcacuccuuucccaaagcaccauaccagagaccauucuugaacugacugacgcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaucuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggacuuuguggucacaacugacauuucagaaaugggugccaacuucaaggcugaaaggguuauagaccccagacguugcaugaaaccaguuauacuaacagaaggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugacuuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcucuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6835 - RNA, 9876 nt, Artificial Sequence
  derived and/or modified CDS sequence (wt) from DENV-2__EU482604__SS-prME
acagcaggcgugaucauuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaacugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggagggagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaauacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccaucuuaggugacacagccugggacuuuggaucccugggaggaguguucacaucuauaggaaaggcucuccaccaaguuuucggagcaaucuacggggcugcuuuuaguggggucucauggaccaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcaaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugugaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacucccuggucacagccggacaugggcagauugacaacuuuucacuaggagucuugggaauggcacuguuccuggaagaaaugcucaggacccgaguaggaacgaaacaugcaauacugcuaguugcaguaucuuuuguaacauugaucacugggaacaugucuuuuagagaccugggaagagugaugguuauggugggcgccaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuggccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaaguuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccggaaaaaaagauugaccaucauggaccuccauccaggagcaggaaagacaaaaagauaccuuccagccauagucagagaagccauaaagcguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcaugucucaggaaaaauggaaagaaagugauacaacucaguaggaaaacuuuugacucugaguauguuaagaccagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaauccuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucuugguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaaguugaugagaaucacggcagaguggcuuuggaaagaacuaggaaagaaaaagaccccuagaaugugcaccagagaagaauucacaagaaaagugagaagcaaugcagccuugggggccauauucacugaugagaacaaauggaaaucggcacgcgaggcuguugaagaugguagguuuugggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugauaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagaugaacugauugguagagcccgaauuucccagggagccggguggucuuugaaagagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccuguggaaucaugggaagaagucccauacuugggaaaaagagaagaccaauggugcggcucauuaauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6836 - RNA, 9876 nt, Artificial Sequence
  derived and/or modified CDS sequence (wt) from DENV-2__EU482605__SS-prME
acagcaggcgugaucauuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaacugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggagggagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuggucacaggacaucucaagugcagacugagaauggacaaacuacagcucaaaggaaugucauacucuauguguacaggaaaguuuaaaauugugaaagaaauagcagaaacacaacauggaacaauaguuaucagaauacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccaucuuaggugacacagccugggacuuuggaucccugggaggaguguucacaucuauaggaaaggcucuccaccaaguuuucggagcaaucuacggggcugcuuuuaguggggucucauggaccaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcaaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugugaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacucccuggucacagccggacaugggcagauugacaacuuuucacuaggagucuugggaauggcacuguuccuggaagaaaugcucaggacccgaguaggaacgaaacaugcaauacugcuaguugcaguaucuuuuguaacauugaucacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuggccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccacacaauguggcacgucacacguggugcuguucugaugcauagagggaagaggauugaaccaucaugggcagaugucaagaaagaccuaauaucauauggaggaggcuggaaguuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagccaauccagagaucgaagaugccauuuuccgaaaaaaaagauugaccaucauggaccuccauccaggagcaggaaagccaaaaagaucccuuccagccauagucagagaagccauaaagcguggcuugagaccauuaauucuggcucccccuagagucgugccagcugaaauggaggaaccucuuagaggccucccaauaagauaccaaaccccagccaucaaacccgaccauaccggccgggagaucguggcccuaaugugccaugccccauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcaugucucaggaaaaauggaaagaaagugauacaacucaguaggaaaacuuuugacucugaguauguuaagaccagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaaucuuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucuugguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagagguugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgcgaggcuguugaagaugguagguuuugggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugauaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagaugaacugauugguagagcccgaauuucccagggagccggguggucuuugaaagagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccuguggaaucaugggaagaagucccauacuugggaaaaagagaagaccaauggugcggcucauuaauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6837 - RNA, 9876 nt, Artificial Sequence
  derived and/or modified CDS sequence (wt) from DENV-2__EU482606__SS-prME
acagcaggcgugaucauuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaacugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggagggagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaauacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccaucuuaggugacacagccugggacuuuggaucccugggaggaguguucacaucuauaggaaaggcucuccaccaaguuuucggagcaaucuacggggcugcuuuuaguggggucucauggaccaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcaaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugugaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacucccuggucacagccggacaugggcagauugacaacuuuucacuaggagucuugggaauggcacuguuccuggaagaaaugcucaggacccgaguaggaacgaaacaugcaauacugcuaguugcaguaucuuuuguaacauugaucacugggaacaugucuuuuagagaccugggaagagugaugguuauggugggcgccaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuggccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaaguuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccggaaaaaaagauugaccaucauggaccuccauccaggagcaggaaagacaaaaagauaccuuccagccauagucagagaagccauaaagcguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugccaucccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcaugucucaggaaaaauggaaagaaagugauacaacucaguaggaaaacuuuugacucugaguauguuaagaccagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaauccuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucuugguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaaguugaugagaaucacggcagaguggcuuuggaaagaacuaggaaagaaaaagaccccuagaaugugcaccagagaagaauucacaagaaaagugagaagcaaugcagccuugggggccauauucacugaugagaacaaauggaaaucggcacgcgaggcuguugaagaugguagguuuugggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugauaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagaugaacugauugguagagcccgaauuucccagggagccggguggucuuugaaagagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccuguggaaucaugggaagaagucccauacuugggaaaaagagaagaccaauggugcggcucauuaauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6838 - RNA, 9876 nt, Artificial Sequence
  derived and/or modified CDS sequence (wt) from DENV-2__EU482607__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucaccuacaaguguccucuccucagacaaaaugaaccagaagacauagacuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaagcauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaguaucaaauagagacuucguagaagggguuucaggaggaagcuggguugauauagucuuggaacauggaaguugugugacgacgauggcaaaaaacaaaccaacauuggauuuugaacugauaaaaacagaagccaaacaaccugccacucuaaggaaauacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaguagugcagccagaaaauuuggaauacaccaucgugauaacaccucacucaggagaagagcacgcuguagguaaugacacaggaaaacauggcaaggaaaucaaaauaacaccacagaguuccaucauagaagcagaacugacaggcuauggcacugucacgauggagugcucuccgagaacgggccuugacuucaaugagauggugcugcugcagauggaagacaaagcuuggcuggugcacaggcaaugguuccuagaccugccguuaccguggcuaccuggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuugggccgccugaucacaguuaacccaaucguaacaggaaaagauagcccagucaacauagaagcagaaccuccauucggggacagcuacaucaucauaggaguagagccgggacaauugaaacucaauugguuuaagaagggaaguuccaucggccaaauguucgagacaacaaugagaggagcaaagagaauggcuauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguacuggugggagucgugacacuguaccugggagcuauggugcaggcugauaguggcugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuugcggaauccgcucaguaacaagauuggagaaccugauguggaaacaaauaacaccagaauugaaucauauucuaucagaaaaugaaguaaaguugaccauuaugacaggagacauuaaaggaaucaugcaagcaggaaaacgauccuugcggccccagcccacugagcugaaguacucauggaaaacauggggaaaggcgaaaaugcucuccacagaaucucacaaccagaccuuucuuauugauggcccugaaacagcagaaugccccaauacaaacagagcuuggaacucacuggaaguugaagacuaugguuuuggaguuuuuaccaccaauauauggcuaaaauugagagaaaaacaggauguauuuugugacucaaaacucaugucagcggccaucaaagacaacagagccguucacgccgauauggguuauuggauagaaagcgcacucaaugacacauggaagauggagaaagccuccuucauugaaguuaaaagcugccauuggccaaagucacacacccuuuggagcaauggaguauuagagagugagaugauaauuccaaaaaacuuugccgggccagugucacaacacaacuacagaccaggcuaccauacacaaacagcaggaccuuggcaucuagguaagcuugagauggacuuugauuucugcgaaggaacuacaguaguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcaaccaugacggaugacauagguaugggagugacuuaucuugcccuacuagcagcuuucaaaguuagaccaacuuuugcagcuggacuacucuugagaaaacugaccuccaaagaauuaaugauggccaccauaggaaucgcacuccuuucccaaagcaccauaccagagaccauucuugaacugacugaugcguuagccuugggcaugaugguccucaaaauagugagaaauauggaaaaauaccaauuggcagugacugucauggcuauuucgugugucccaaaugcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuacuguauguuacgugcucacuggacgaucggcugauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcgugguaccugugggaagugaagaaacaacgggcuggaguauugugggacguuccuucacccccaccagugggaaaagccgaacuggaggauggagccuacagaauuaagcaaagagggauucuuggauauucucagauuggagccggaguuuacaaagaaggaacauuccauacaauguggcacgucacacguggugcuguccugaugcauagagggaagaggauugaaccaucaugggcagaugucaagaaagacuuaauaucauauggaggaggcuggaagcuagaaggagaauggaaggaaggagaggaaguccaaguccuggcacuggaaccuggaaaaaauccaagagccguccaaacaaaaccuggaauuuucaaaaccgacaccggaaccauaggcgccguaucucuggacuuuuccccuggaacgucaggaucuccaauugucgacagaaagggaaagguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagccgaaauggaggaagcucuuagaggacuuccaauaagauaccaaaccccagccaucaaagccgaacacaccgggcgggagauuguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacaguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaauuucaaggcugagaggguuauagaccccagacguugcaugaaaccagucauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuuggcccugaaccuaaucacagaaauggguaggcuuccaacuuucaugacccagaaggcaagaaacgcacuggacaacuuggcugugcugcauacggcugaggcagguggaagggcguacaaucaugcucucagugaacugccggagacucuggagacacugcuucuacugacacuccuggcaacagucacaggaggaaucuucuuauucuuaaugagcggaaaagguauagggaagaugacccugggaauguguugcauaaucacggcuaguguccuccuaugguaugcacagauacaaccacacuggauagcagcuucaauaauacuggaguuuuuucucauaguuuugcucauuccagagccagaaaaacagagaacaccccaagacaaccaauugaccuacguugucauagccauccucacagugguggcugcaaccauggcaaacgagauggguuuccuggaaaaaaccaagaaagaccucggauugggaagcauuacaacccaggaaucugagagcaacauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauaggcccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaacccuagcgaccgggcccaucuccacacugugggaaggaaauccagggagguuuuggaacacuaccaucgcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcgcuggggaaaagugaauuucagaucuacaagaaaaguggaauccaggaaguggauagaacccuagcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauacaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacuacugacaaaaccuugggacgucgucccuauggugacacagauggcaaugacagacacgacuccauuuggacaacagcgcguuuucaaggagaaaguagacacgagaacccaagaaccgaaggaaggcacgaagaagcugaugaaaaucacggcagaguggcuuuggaaagaacuaggaaagaaaaagacaccuaggauguguaccagagaagaauucacaagaaaagugagaagcaaugcagccuugggggccauauucaccgaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaagcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggauacaagaaucacacuagaagauuuaaaaaaugaagaaaugguaacaaaccacaugaaaggagaacacaagaaacuagcugaggccauauucaaauuaacguaccaaaauaagguggugcgugugcaaagaccaacaccaagaggcacaguaauggauaucauaucgagaaaagaccaaagaggcaguggacaagucggcaccuauggccuuaauacuuucaccaauauggaagcccaauuaaucagacagauggaaggagaaggaaucuuuaaaagcauucagcaccugacagccacagaagaaaucgcuguacagaacugguuaacaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuugggaaaaagagaagaccaaugguguggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguucugugguag

SEQ ID NO: 6839 - RNA, 9876 nt, Artificial Sequence
  derived and/or modified CDS sequence (wt) from DENV-2__EU482608__SS-prME
acagcaggcgugaucauuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaacugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggagggagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaauacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccaucuuaggugacacagccugggacuuuggaucccugggaggaguguucacaucuauaggaaaggcucuccaccaaguuuucggagcaaucuacggggcugcuuuuaguggggucucauggaccaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcaaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugugaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacucccuggucacagccggacaugggcagauugacaacuuuucacuaggagucuugggaauggcacuguuccuggaagaaaugcucaggacccgaguaggaacgaaacaugcaauacugcuaguugcaguaucuuuuguaacauugaucacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuggccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccacacaauguggcacgucacacguggugcuguucugaugcauagagggaagaggauugaaccaucaugggcagaugucaagaaagaccuaauaucauauggaggaggcuggaaguuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagccauagucagagaagccauaaagcguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcaugucucaggaaaaauggaaagaaagugauacaacucaguaggaaaacuuuugacucugaguauguuaagaccagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaaucuuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucuugguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagagguugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgcgaggcuguugaagaugguagguuuugggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaucaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugauaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagaugaacugauugguagagcccgaauuucccagggagccggguggucuuugaaagagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccuguggaaucaugggaagaagucccauacuugggaaaaagagaagaccaauggugcggcucauuaauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6840 - RNA, 9876 nt, Artificial Sequence
  derived and/or modified CDS sequence (wt) from DENV-2__EU687220__SS-prME
acagcaggcgugauuauuauguuaauuccaacagcaauggcguuccauuuaaccacacguaauggagaaccacacaugauuguugguaggcaagagaaaggaaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucguuccacacguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaaaggccuugauuuuuauuuuacugacagcugucgcuccuucaaugacaaugcguuguauaggaauaucaaauagagacuucguagaagggguuucaggaggaagcuggguugacauagucuuagaacauggaaguugugugacgacgauggcaaagaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguuuacaugcaaaaagaacauggaaggaaaagucgugcugccagaaaaucuggaauacaccaucgugauaacaccucacucaggagaagagcacgccguaggcaaugacacaggaaaacauggcaaggaaaucaaaauaacaccacagaguuccaucacagaagcagaacugacaggcuauggcacugucacgauggagugcucuccgagaacgggucucgacuucaaugagauggugcugcugcagauggaagagaaagcuuggcuggugcacaggcaaugguuccuagaccugccgcuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccaaucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggcuauuuuaggugacacagccugggauuuuggaucccugggaggaguguuuacaucuauaggaaaggcucuccaccaaguuuuuggagcaaucuauggggcugcuuuuaguggggucucauggacuaugaaaauccucauaggagucaucaucacauggauaggaaugaauucacgaagcaccucacugucugugucacuaguauuggugggagucgugacacuguaccugggagcuauggugcaggcugauagugguugcguugugagcuggaaaaacaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaaguugaccaucaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcggaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacauacccucuggagcaauggaguauuggaaagugaaaugauaauuccaaaaaauuuugccgggccagugucacaacacaacuacagaccaggcuaccacacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacaaaacaugcaauacugcuaguugcaguaucuuuugugacauugauuacugggaacauguccuuuagagaccugggaagagugaugguuauggugggcgcuaccaugacggaugacauagguaugggagugacuuaccuugcccuacuagcagcuuucaaaguuagaccaacuuucgcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugaggaauauggaaaaguaccaauuggcagugacuaucauggcuaucucgugugucccaaaugcagugauacugcuaaacgcauggaaggugaguugcacaauacuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcaucuuagccaguucucuccuaaagaaugacauucccaugacagguccauuaguggcuggagggcuccuuaccguguguuacgugcucacuggacgaucggccgauuuggaacuggagagagcugccgauguaaaaugggaagaucacgcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaauuacggcagcagcaugguaccugugggaagugaagaaacaacgggcuggaguauugugggacguuccuucacccccaccagugggaaaagccgaacuggaagauggagccuauagaaucaagcaaagagggauucuuggauauucucagauuggagccggaguuuacaaagaaggaacauuccacacaauguggcacgucacacguggugcuguucugaugcauagagggaagaggauugaaccaucaugggcagacgucaagaaagaccuaauaucauauggaggaggcuggaaguuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugccauagcccagaccgaaaaaagcauugaagacaauccagagaucgaagaugacauuuuccgaaagaagagauugaccaucauggaccuccauccaggagcaggaaagacaaaaagauaccuuccagccauaguuagagaagccauaaaacguggcuugagaacguuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauauauuucaacccgaguagaaaugggugaagcagcugggauuuucaugacagccacuccuccgggaaguagagacccguuuccucagagcaaugcaccaaucauggaugaggaaagagaaaucccugagcgcucguggaauucaggacaugaauggguuacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacgaaagaaggggaaaggaagaaauuaaaacccagaugguuggaugcuaggaucuauucugacccacuggcacuaaaagaauucaaggaguuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuugcugacacuccuggcuacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcuuauuccagaaccagaaaaacagagaacaccccaagacaaccaauugaccuacguaguuauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguguuaaugaugaggacuacaugggcucugugugaggcucuaacccuagcgaccgggcccaucuccacacugugggaaggaaauccagggagguuuuggaacacuaccauugcggugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaacauggucacaccagaagggaaggugguggaccucgguuguggcagagggggcuggucauacuauugugggggacuaaagaauguaagagaagucaaaggccugacaaaaggaggaccaggacacgaagaacccauccccaugucaacauauggguggaaucuagugcgucugcaaaguggagucgacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguucucaacccauauaugcccucagucauagaaaaaauggaaacacuacaaagaaaauauggaggagccuuagugaggaauccacucucacgaaacuccacacaugagauguacuggguauccaaugcuaccgggaacauagugucaucagugaacaugaucucaaggauguugauuaacagauucacaaugaaacacaagaaagccaccuacgagccagauguugaccuaggaagcggaacccgcaacauuggaauugaaagugagauaccaaaucuagacauaauaggaaaaagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacuacugacaaaaccuugggacgucgucccuauggugacacagauggcaaugacagacacgacuccuuuuggacaacaacgcguuuucaaagagaaaguggacacgagaacccaagaaccgaaggagggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcgauguacgccgaugauacagcaggaugggacacaagaaucacacuagaagacuuaaaaaaugaagaaaugguaacaaaccacaugaaaggagaacacaagaaacuagccgaggccauauuuaaauuaacguaccaaaacaagguggugcgugugcaaagaccaacaccaagaggcacaguaauggacaucauaucgagaagagaccaaagaggcagugggcaaguuggcaccuauggccuuaauacuuucaccaacauggaagcccaauuaauuagacagauggagggagaaggaaucuucaaaagcauucagcaccugacagucacagaagaaaucgcuguacagaacugguuaguaagaguggggcgugaaaggcuaucaagaauggccaucaguggagaugauuguguuguaaaaccuuuagaugacagauuugcaagugcuuuaacagcccuaaaugacauggggaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauuggcagagcccgaauuucccagggagccggguggucuuugaaggagacggccuguuugggaaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguauggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6841 - RNA, 9876 nt, Artificial Sequence
  derived and/or modified CDS sequence (wt) from DENV-2__EU726775__SS-prME
acagcaggcgugauuguuauguugauuccaacagcgauggcguuccauuuaaccacacgcaauggagaaccacacaugaucguugguaggcaggagaaagggaaaagucuucuguuuaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaagaauaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguacuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauucccaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaauaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacuauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucagaaccaacaccggaaccauaggcgccauaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucaaagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugacauagcagcuugucuuaggaaaaauggaaagaaagugauacaacucaguaggaagacuuuugacucugaauauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcggcuggaagaaaaucuuugacccugaaccuaaucacagaaauggguaggcuuccaacuuucaugacucagaaggcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaacauccuggacauagaucuacgcccugcaucagcauggacgcuguaugccguggcuacaacauuugucacaccaauguugagacauagcauugaaaauuccucagugaaugucucucuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacaguaauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucagaucuacaagaaaaguggaauccaggaaguggauagaacccuagcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguagacacgagaacccaagaaccgaaggaaggcacgaagaagcugaugaaaaucacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagauggcagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucagaagcauucagcaccugacagccacagaagaaaucgcuguacagaacugguuagcaagaguggggcgcgaaaggcuaucaagaauggcaaucaguggagaugauugugucguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6842 - RNA, 9876 nt, Artificial Sequence
  derived and/or modified CDS sequence (wt) from DENV-2__FJ639732__SS-prME
acagcaggcgugaucguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauuacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaguacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucauuacagauaacguacacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccgucaaagacaacagagcuguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuuaagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaacuagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccggaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugauuaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagacuagagcuaaugauugggacuuuguggucacgacugacauuucagaaaugggugccaacuucaaagccgagaggguuauagaccccagacguugcaugaaaccaguuauacuaacagauggcgaagagcgggugauuuuggcaggaccuaugccagugacccacucuagugcagcgcaaagaagagggagaauaggaagaaauccaaaaaaugaaaaugaccaguacauauacaugggggaaccucucgaaaacgaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccugaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaaccuagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgaggagagaccaaagaggcagugggcaggucggcaccuauggccucaauacuuucaccaauauggaagcccaauuaauuagacagauggagggagaaggaaucuucaaaagcauccagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6843 - RNA, 9876 nt, Artificial Sequence
  derived and/or modified CDS sequence (wt) from DENV-2__FJ639733__SS-prME
acagcaggcgugaucauuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggagguauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaguacaauaugaaggggacgguucuccaugcaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgaggcaacaaugagaggagcaaagagaauggccauuuuaggugacacagccugggauuuuggaucccuggggggagcguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaauuaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccgccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaagauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccacuaaaugaagcuaucauggcagucgggauggugagcauuuuagccaguucucuccuaaaaaaugauauucccaugacaggcccauuaguggcuggagggcuucuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccggaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaaaacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaauacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccagagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauuaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaagagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcaggugucuugugguag

SEQ ID NO: 6844 - RNA, 9876 nt, Artificial Sequence
  derived and/or modified CDS sequence (wt) from DENV-2__FJ639734__SS-prME
acagcaggcgugauuguuauguugauuccaacagcgauagcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggaugggggaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguggguaaugacacaggaaaacacggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuaccuggagcugacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaagaaauagcagaaacacaacauggaacaauaguuaucagaguacaauaugaaggggacgguucuccauguaagaucccuuuugagauaacagacuuggaaaaaagacacgucuuaggucgccugauuacaguuaacccaaucguaacagaaaaagauagcccagucaacauagaagcagaaccuccauucggagacagcuacaucaucauaggaguagagccgggacaacugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuauaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucgcuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugaucucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacaggcccauuaguggcuggagggcuccuuaccguauguuacgugcucacuggacgaucggccgauuuggaacuggagagagcugccgagguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuucauccaggagcaggaaagacaaaaagauaccuuccagccauaguuagagaagccauaaaacguggcuugagaacauuaauccuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaagacuuuugacucugaguauguuaagacuagagccaaugauugggacuuuguggucacgacugacauuucagaaaugggugccaacuucaaagcugagaggguaauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuuccuauucuuaaugagcggaaaagguauagggaagaugacccugggaauguguugcauaaucacggccaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguagcugcaaccauggcaaacgagauggguuuccuggaaaaaaccaagaaagaccucggauugggaagcauuacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccaucggaugcuacucacaagucaacccuauaacucucacagcagcucuucuuuuauugguagcacauuaugccauuauagggccaggacuccaagcaaaagcaaccagagaagcacagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacugaagaauguaagagaagucaaaggccuaacaaaaggaggaccaggacacgaagaacccaucccuaugucaacauauggguggaauuuagugcgucugcaaagcggaguugacguuuucuucaccccgccagaaaaaugugauacauuguugugugacauaggggagucgucaccaaaucccacgauagaagcaggacgaacacucagaguccucaacuuaguagaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugaaaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggagaguucggcaaggcaaaaggcagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgcgcucguagucccaugcagaaaccaagaugaacugauugguagagcccgaacuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6845 - RNA, 9876 nt, Artificial Sequence
  derived and/or modified CDS sequence (wt) from DENV-2__JN819408__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcuuguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaagaauaaaccaacauuggauuuugaacugauaaaaacagaagccaaacaaccugccacucuaaggaaguacuguauagaagcaaagcugacuaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccccacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaagaaauagcagaaacacaacauggaacaauaguuaucagaguacaauaugaaggggacgguucuccauguaagaucccuuuugagauaacagauuuggagaaaagacacgucuuaggucgccugauuacaguuaacccaaucguaacagaaaaagauagcccagucaacauagaagcagaaccuccauucggagacagcuacaucaucauaggaguagagccgggacaauugaaacuuaauugguuuaagaagggaaguuccaucggccaaauguucgagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucauuaucacauggauaggaaugaauucacguagcaccucacugucugugucgcuaguacuggugggagucgugacacuguacuugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagagugccccaacacaaacagagcuuggaacucgcuggaaguugaagacuaugguuucggaguuuuuaccaccaauauauggcuaaaacugagagaaaaacaggauauauuuugugacucaaaacucaugucagcggccauuaaagauaacagagccguucaugccgauauggguuauuggauagaaagugcacucaaugacacauggaagauggagaaagccuccuucauugagguuaagagcugccauuggccaaagucacacacccucuggagcaauggaguauuagaaagugagaugauaauuccaaaaaauuuugccgggccagugucacaacacaacuacagaccaggcuaccauacacaaacagcaggaccuuggcaucuaggcaagcuugagauggacuuugauuucugcgaaggaacuacagugguagugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgagugggaacgaaacaugcaauacugcuaguugcaguaucuuuugugacauugauuacugggaacaugucuuuuagagacuugggaagagugaugguuauggugggcgccaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcacuauaccagagaccauucuugaacugacugaugcguuagccuugggcaugauggcccucaaaauagugagaaauauggaaaaauaccaauuggcagugacuaucauggcuauuucgugugucccaaaugcagugauacugcaaaacgcauggaaggugaguugcacaauauuggcagcgguguccguuucuccacugcucuuaacauccucacagcaaaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuagaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucagaaccaacaccggaaccauaggcgccguaucucuggacuuuuccccuggaacgucaggaucuccaauugucgacagaaaaggaaaagucgugggucuuuacgguaaugguguugucacaaggaguggagcauauguaagugcuauagcccagaccgaaaaaagcauugaagacaauccagagaucgaagaugacauuuuucgaaagaaaagauugaccaucauggaccuccauccaggagcaggaaagacaaaaagauaccuuccagccauaguuagagaagccauaaaacguggcuugagaacauugauccuggcucccacuagagucguggcagcugaaauggaggaagcucuuagaggacuuccaauaagauaccaaaccccagccaucaaagcugagcacaccgggcgggagaucguggaccuaaugugucaugccacauuuacuaugaggcugcuaucaccagucagagugccaaauuacaaccugaucaucauggacgaagcccacuucacagacccagcaagcauagcagcuagaggauacauuucaacucgaguagagaugggugaagcagccgggauuuucaugacagccacuccuccgggaaguagagacccauuuccucagagcaaugcaccaauaauggaugaggaaagagaaaucccugagcguucguggaauucaggacaugaaugggucacggauuuuaaggggaagacuguuugguuuguuccaaguauaaaagcaggaaaugacauagcagcuugucuuaggaaaaauggaaagaaagugauacaacucaguaggaagacuuuugacucugaauauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguauauauacaugggggaaccucucgaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaaucaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugaggcagguggaagggcguacaaucaugcucucagugaacugccggagacccuggagacacuacuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuauaacccaggaaucugagaacaacauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugacuuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucagaucuacaagaaaaguggaauccaggaaguggauagaacccuagcaaaagaaggcaucaaaagaggagaaacggaccaccaugcugugucgcgagguucagcaaaacugagaugguucgucgagagaaauauggucacaccggaagggaaggugguagaucucgguugcggcagagggggcuggucauacuauugcgggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugugauacacuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaaacauugcaaaggaaauauggaggagccuuagugaggaauccacuuucacgaaacuccacgcaugaaauguacuggguaucuaaugccaccgggaacauagugucaucagugaacaugauuucaagaauguugauuaacagauucacaaugaaacacaagaaagccaccuacgagccagauguugaccuaggaaguggaacccgcaacauuggaauugagggugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguagacacgagaacccaagaaccgaaggaaggcacgaagaagcugaugaaaaucacggcagaguggcuuuggaaagaacuaggaaagaaaaagacaccuaggauguguaccagagaagaauucacaaaaaaagugagaagcaaugcagccuugggggccauauucacugaugagaacaaauggaaaucggcacgugaggcuguugaagauggcagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuccuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauccagcaccugacagccacagaagaaaucgcuguacagaacugguuagcaagaguggggcgugaaaggcuaucaagaauggcaaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6846 - RNA, 9876 nt, Artificial Sequence
  derived and/or modified CDS sequence (wt) from DENV-2__FJ639783__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucaccuacaaguguccucuccucagacaaaaugaaccagaagacauagacuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaguaucaaauagagacuucguagaagggguuucaggaggaagcuggguugauauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccuugacuucaaugagauggugcugcugcagauggaagacaaagcuuggcuggugcacaggcaaugguuccuagaccugccguuaccguggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggccgccugaucacaguuaacccaaucguaacagaaaaagauagcccagucaacauagaagcagaaccuccauucggggacagcuacaucaucauaggaguagagccgggacaauugaaacucaauugguuuaagaagggaaguuccaucggccaaauguucgagacaacaaugagaggagcaaagagaauggcuauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguacuggugggagucgugacacuguaccugggagcuauggugcaggcugauaguggcugcguugugagcuggaaaaauaaagaacugaaauguggcagugggaucuucaucacagacaacguacacacauggacagaacaauauaaguuccaaccagaauccccuucaaaacuagcuucagcuauccaaaaagcucaugaagagggcauuuguggaauccgcucaguaacaagauuggagaaccugauguggaaacaaauaacaccagaauugaaucauauucuaucagaaaaugaaguaaaguugaccauuaugacaggagacauuaaaggaaucaugcaagcaggaaaacgauccuugcggccccagcccacugagcugaaguacucauggaaaacauggggaaaggcgaaaaugcucuccacagaaucucacaaucagaccuuucuuauugauggcccugaaacagcagaaugccccaauacaaacagagcuuggaacucacuggaaguugaagacuaugguuuuggaguuuuuaccaccaauauauggcuaaaauugagagaaaaacaggauguauuuugugacucaaaacucaugucagcggccaucaaagacaacagagccguucacgccgauauggguuauuggauagaaagcgcacucaaugacacauggaagauggagaaagccuccuucauugaaguuaaaagcugccauuggccaaagucacacacccuuuggagcaauggaguauuagaaagugagaugauaauuccaaaaaacuuugccgggccagugucacaacacaacuacagaccaggcuaccauacacaaacagcaggaccuuggcaucuagguaagcuugagauggacuuugauuucugcgaaggaacuacgguaguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcaaccaugacggaugacauagguaugggagugacuuaucuugcccuacuagcagcuuucaaaguuagaccaacuuuugcagcuggacuacucuugagaaaacugaccuccaaagaauuaaugauggccaccauaggaaucgcacuccuuucccaaagcaccauaccagagaccauucuugaacugacugaugcguuagccuugggcaugaugguccucaaaauagugagaaauauggaaaaauaccaauuggcagugacugucauggcuauuucgugugucccaaaugcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuacuguauguuacgugcucacuggacgaucggcugauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaggauggagccuacagaauuaagcaaagagggauucuuggauauucucagauuggagccggaguuuacaaagaaggaacauuccauacaauguggcacgucacacguggugcuguccugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacaaaaccuggaauuuucaaaaccaacaccggaaccauaggcgccguaucucuggacuuuuccccuggaacgucaggaucuccaauugucgacagaaaaggaaagguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagccgaaauggaggaagcucuuagaggacuuccaauaagauaccaaaccccagccaucaaagccgaacacaccgggcgggagauuguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaauuucaaggcugagaggguuauagaccccagacguugcaugaaaccagucauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacccagaaggcaagaaacgcacuggacaacuuggcugugcugcauacggcugaggcagguggaagggcguacaaucaugcucucagugaacugccggagacucuggagacacugcuucuacugacacuccuggcaacagucacaggaggaaucuucuuauucuuaaugagcggaaaagguauagggaagaugacccugggaauguguugcauaaucacggcuaguguccuccuaugguaugcacagauacaaccacacuggauagcagcuucaauaauacuggaguuuuuucucauaguuuugcucauuccagagccagaaaaacagagaacaccccaagacaaccaauugaccuacguugucauagccauccucacagugguggcugcaaccauggcaaacgagauggguuuccuggaaaaaaccaagaaagaccucggauugggaagcauuacaacccaggaaucugagagcaacauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauaggcccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcgcuggggaaaagugaauuucagaucuacaagaaaaguggaauccaggaaguggauagaacccuagcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauacaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguagacacgagaacccaagaaccgaaggaaggcacgaagaagcugaugaaaaucacggcagaguggcuuuggaaagaacuaggaaagaaaaagacaccuaggauguguaccagagaagaauucacaagaaaagugagaagcaaugcagccuugggggccauauucaccgaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaagcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguaugccgaugauacagcaggaugggauacaagaaucacacuagaagacuuaaaaaaugaagaaaugguaacaaaccacaugaaaggagaacacaagaaacuagcugaggccauauucaaauuaacguaccaaaauaagguggugcgugugcaaagaccaacaccaagaggcacaguaauggauaucauaucgagaagagaccaaagaggcagugggcaagucggcaccuauggccuuaauacuuucaccaauauggaagcccaauuaaucagacagauggaaggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguucugugguag

SEQ ID NO: 6847 - RNA, 9876 nt, Artificial Sequence
  derived and/or modified CDS sequence (wt) from DENV-2__FJ639788__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucaccuacaaguguccucuccucagacaaaaugaaccagaagacauagacuguuggugcaacucuacguccacauggguaacuuaugggacauguaccaccgcaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaguaucaaauagagacuucguagaagggguuucaggaggaagcuggguugauauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccuugacuucaaugagauggugcugcugcagauggaagacaaagcuuggcuggugcacaggcaaugguuccuagaccugccguuaccguggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggccgccugaucacaguuaacccaaucguaacagaaaaagauagcccagucaacauagaagcagaaccuccauucggggacagcuacaucaucauaggaguagagccgggacaauugaaacucaauugguuuaagaagggaaguuccaucggccaaauguucgagacaacaaugagaggagcaaagagaauggcuauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguacuggugggagucgugacacuguaccugggagcuauggugcaggcugauaguggcugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaccugauguggaaacaaauaacaccagaauugaaucauauucuaucagaaaaugaaguaaaguugaccauuaugacaggagacauuaaaggaaucaugcaagcaggaaaacgauccuugcggccccagcccacugagcugaaguacucauggaaaacauggggaaaggcgaaaaugcucuccacagaaucucacaaucagaccuuucuuauugauggcccugaaacagcagaaugccccaauacaaacagagcuuggaacucacuggaaguugaagacuaugguuuuggaguuuuuaccaccaauauauggcuaaaauugagagaaaaacaggauguauuuugugacucaaaacucaugucagcggccaucaaagacaacagagccguucacgccgauauggguuauuggauagaaagcgcacucaaugacacauggaagauggagaaagccuccuucauugaaguuaaaagcugccauuggccaaagucacacacccuuuggagcaauggaguauuagaaagugagaugauaauuccaaaaaacuuugccgggccagugucacaacacaacuacagaccaggcuaccauacacaaacagcaggaccuuggcaucuagguaagcuugagauggacuuugauuucugcgaaggaacuacaguaguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcaaccaugacggaugacauagguaugggagugacuuaucuugcccuacuagcagcuuucaaaguuagaccaacuuuugcagcuggacuacucuugagaaaacugaccuccaaagaauuaaugauggccaccauaggaaucgcacuccuuucccaaagcaccauaccagagaccauucuugaacugacugaugcguuagccuugggcaugaugguccucaaaauagugagaaauauggaaaaauaccaauuggcagugacugucauggcuauuucgugugucccaaaugcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuacuguauguuacgugcucacuggacgaucggcugauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaggauggagccuacagaauuaagcaaagagggauucuuggauauucucagauuggagccggaguuuacaaagaaggaacauuccauacaauguggcacgucacacguggugcuguccugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacaaaaccuggaauuuucaaaaccaacaccggaaccauaggcgccguaucucuggacuuuuccccuggaacgucaggaucuccaauugucgacagaaaaggaaagguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagccgaaauggaggaagcucuuagaggacuuccaauaagauaccaaaccccagccaucaaagccgaacacaccgggcgggagauuguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaauuucaaggcugagaggguuauagaccccagacguugcaugaaaccagucauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugccaggaucuauucugacccacuggcacuaaaagaauucaaggaauuugcagcuggaagaaaaucuuugacccugaaccuaaucacagaaauggguaggcuuccaacuuucaugacccagaaggcaagaaacgcacuggacaacuuggcugugcugcacacggcugaggcagguggaagggcguacaaucaugcucucagugaacugccggagacucuggagacacugcuucuacugacacuccuggcaacagucacaggaggaaucuucuuauucuuaaugagcggaaaagguauagggaagaugacccugggaauguguugcauaaucacggcuaguguccuccuaugguaugcacagauacaaccacacuggauagcagcuucaauaauacuggaguuuuuucucauaguuuugcucauuccagagccagaaaaacagagaacaccccaagacaaccaauugaccuacguugucauagccauccucacagugguggcugcaaccauggcaaacgagauggguuuccuggaaaaaaccaagaaagaccucggauugggaagcauuacaacccaggaaucugagagcaacauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauaggcccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaacccuagcgaccgggcccaucuccacacugugggaaggaaauccagggagguuuuggaacacuaccaucgcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcgcuggggaaaagugaauuucagaucuacaagaaaaguggaauccaggaaguggauagaacccuagcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacuauaacacccaauuuugcauaaagguccucaacccauacaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguagacacgagaacccaagaaccgaaggaaggcacgaagaagcugaugaaaaucacggcagaguggcuuuggaaagaacuaggaaagaaaaagacaccuaggauguguaccagagaagaauucacaagaaaagugagaagcaaugcagccuugggggccauauucaccgaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaagcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggauacaagaaucacacuagaagacuuaaaaaaugaagaaaugguaacaaaccacaugaaaggagaacacaagaaacuagcugaggccauauucaaauuaacguaccaaaauaagguggugcgugugcaaagaccaacaccaagaggcacaguaauggauaucauaucgagaagagaccaaagaggcagugggcaagucggcaccuauggccuuaauacuuucaccaauauggaagcccaauuaaucagacagauggaaggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuauaugccauccaugaagagauucagaagggaagaggaagaggcagguguucugugguag

SEQ ID NO: 6848 - RNA, 9876 nt, Artificial Sequence
  derived and/or modified CDS sequence (wt) from DENV-2__FJ639822__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucaccuacaaguguccucuccucagacaaaaugaaccagaagacauagacuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaagcauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaguaucaaauagagacuucguagaagggguuucaggaggaagcuggguugauauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaaacauggcaaggaaaucaaaauaacaccacagaguuccaucauagaagcagaacugacaggcuauggcacugucacgauggagugcucuccgagaacgggccuugacuucaaugagauggugcugcugcagauggaagacaaagcuuggcuggugcacaggcaaugguuccuagaccugccguuaccguggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggccgccugaucacaguuaacccaaucguaacaggaaaagauagcccagucaacauagaagcagaaccuccauucggggacagcuacaucaucauaggaguagagccgggacaauugaaacucaauugguuuaagaagggaaguuccaucggccaaauguucgagacaacaaugagaggagcaaagagaauggcuauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguacuggugggagucgugacacuguaccugggagcuauggugcaggcugauaguggcugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaccugauguggaaacaaauaacaccagaauugaaucauauucuaucagaaaaugaaguaaaguugaccauuaugacaggagacauuaaaggaaucaugcaagcaggaaaacgauccuugcggccccagcccacugagcugaaguacucauggaaaacauggggaaaggcgaaaaugcucuccacagaaucucacaaucagaccuuucuuauugauggcccugaaacagcagaaugccccaauacaaacagagcuuggaacucacuggaaguugaagacuaugguuuuggaguuuuuaccaccaauauauggcuaaaauugagagaaaaacaggauguauuuugugacucaaaacucaugucagcggccaucaaagacaacagagccguucacgccgauauggguuauuggauagaaagcgcacucaaugacacauggaagauggagaaagccuccuucauugaaguuaaaagcugccauuggccaaagucacacacccuuuggagcaauggaguauuagaaagugagaugauaauuccaaaaaacuuugccgggccagugucacaacacaacuacagaccaggcuaccauacacaaacagcaggaccuuggcaucuagguaagcuugagauggacuuugauuucugcgaaggaacuacaguaguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcaaccaugacggaugacauagguaugggagugacuuaucuugcccuacuagcagcuuucaaaguuagaccaacuuuugcagcuggacuacucuugagaaaacugaccuccaaagaauuaaugauggccaccauaggaaucgcacuccuuucccaaagcaccauaccagagaccauucuugaacugacugaugcguuagccuugggcaugaugguccucaaaauagugagaaauauggaaaaauaccaauuggcagugacugucauggcuauuucgugugucccaaaugcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuacuguauguuacgugcucacuggacgaucggcugauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacguuccuucacccccaccagugggaaaagccgaacuggaggauggagccuacagaauuaagcaaagagggauucuuggauauucucagauuggagccggaguuuacaaagaaggaacauuccauacaauguggcacgucacacguggugcuguccugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacaaaaccuggaauuuucaaaaccaacaccggaaccauaggcgccguaucucuggacuuuuccccuggaacgucaggaucuccaauugucgacagaaaaggaaagguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagccgaaauggaggaagcucuuagaggacuuccaauaagauaccaaaccccagccaucaaagccgaacacaccgggcgggagauuguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaauuucaaggcugagaggguuauagaccccaggcguugcaugaaaccagucauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaagaaaaaaauuaaaacccagaugguuggaugcuaggaucuauucugacccacuggcacuaaaagaauucaaggaauuugcagcuggaagaaaaucuuuggcccugaaccuaaucacagaaauggguaggcuuccaacuuucaugacccagaaggcaagaaacgcacuggacaacuuggcugugcugcauacggcugaggcagguggaagggcguacaaucaugcucucagugaacugccggagacucuggagacacugcuucuacugacacuccuggcaacagucacaggaggaaucuucuuauucuuaaugagcggaaaagguauagggaagaugacccugggaauguguugcauaaucacggcuaguguccuccuaugguaugcacagauacaaccacacuggauagcagcuucaauaauacuggaguuuuuucucauaguuuugcucauuccagagccagaaaaacagagaacaccccaagacaaccaauugaccuacguugucauagccauccucacagugguggcugcaaccauggcaaacgagauggguuuccuggaaaaaaccaagaaagaccucggauugggaagcauuacaacccaggaaucugagagcaacauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauaggcccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaacccuagcgaccgggcccaucuccacacugugggaaggaaauccagggagguuuuggaacacuaccaucgcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcgcuggggaaaagugaauuucagaucuacaagaaaaguggaauccaggaaguggauagaacccuagcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguccucaacccauacaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguagacacgagaacccaagaaccgaaggaaggcacgaagaagcugaugaaaaucacggcagaguggcuuuggaaagaacuaggaaagaaaaagacaccuaggauguguaccagagaagaauucacaagaaaagugagaagcaaugcagccuugggggccauauucaccgaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaagcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggauacaagaaucacacuagaagauuuaaaaaaugaagaaaugguaacaaaccacaugaaaggagaacacaagaaacuagcugaggccauauucaaauuaacguaccaaaauaagguggugcgugugcaaagaccaacaccaagaggcacaguaauggauaucauaucgagaaaagaccaaagagguagugggcaagucggcaccuauggccuuaauacuuucaccaauauggaagcccaauuaaucagacagauggaaggagaaggaaucuuuaaaagcauucagcaccugacagccacagaagaaaucgcuguacagaacugguuaacaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguucugugguag

SEQ ID NO: 6849 - RNA, 9876 nt, Artificial Sequence
  derived and/or modified CDS sequence (wt) from DENV-2__FJ850112__SS-prME
acagcaggcgugaucauuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaacuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaguacaauaugaaggggacgguucuccaugcaagaucccuuuugagauaacagacuuggaaaaaagacacgucuuaggucgccugauuacaguuaacccaaucguaauagaaaaagauagcccaguuaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacagccugggauuuuggaucccuggggggagcguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaauuaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaagauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccggaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaaaacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccagagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauuaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaagagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcaggugucuugugguag

SEQ ID NO: 6850 - RNA, 9876 nt, Artificial Sequence
  derived and/or modified CDS sequence (wt) from DENV-2__FJ850105__SS-prME
acagcuggcgugaucauuauguugauuccaacagcgauggcguuccauuuaaccacacgcaauggagaaccacauaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggagggagcuggguugacauagucuuagaacauggaaguugugugacgacgauggcgaaaaacaaaccaacauuggauuuugaacugauaaaaacagaagccaaacaaccugccacuuuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguuguccuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaauacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucauuauaggagcagagccgggacaauugaaacucaauugguuuaagaagggaaguuccaucggccaaauguucgagacaacaaugagaggagcaaagagaauggccauuuuaggugacacagccugggacuuuggaucccugggaggaguguucacaucuauaggaaaggcucuccaccaaguuuucggagcaaucuauggggcugcuuuuaguggggucucauggaccaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccaguaucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauauagaggugaggauggaugcugguacgggauggaaaucagaccauugaaagagaaagaggagaauuuggucaacucccuggucacagccggacaugggcagauugacaacuuuucacuaggagucuugggaauggcacuguuccuggaagaaaugcucaggacccgaguaggaacgaaacaugcaauacugcuaguugcaguaucuuuuguaacauugauuacugggaacaugucuuuuagagaccugggaagagugaugguuaugguaggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguacuugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccacacaauguggcacgucacacguggugcuguucugaugcauagagggaagaggauugaaccaucaugggcagaugucaagaaagaccuaauaucauauggagggggcuggaaguuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccggaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaagcauaaaagcaggaaaugauauagcagcuugucucaggaaaaauggaaagaaagugauacaacucaguaggaaaacuuuugacucugaguauguuaagacuagagccaaugauugggacuuugugguuacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauauuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaauccuaugugugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucuugguugcggcagagggggcuggucauacuauugugggggauuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugagacaucauggcacuaugaucaagaccacccauacaaaacgugggcuuaccacggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggagccauauucacugaugagaacaaauggaaaucggcacgcgaggcuguugaagaugguagguuuugggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggccgcgugcuuguagucccaugcagaaaccaagaugaacugauugguagagcccgaauuucccagggagccggguggucuuugaaagagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6851 - RNA, 9876 nt, Artificial Sequence
  derived and/or modified CDS sequence (wt) from DENV-2__FJ850106__SS-prME
acagcaggcgugaucauuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggagggagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaauauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaauacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccauuggccaaauguucgagacaacaaugagaggagcaaagagaauggccauuuuaggugacacagccugggacuuuggaucccugggaggaguguucacaucuauaggaaaggcucuccaccaaguuuucggagcaaucuauggggcugcuuuuaguggggucucauggaccaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccaucaaagauaacagagccguucaugccgauauggguuauuggauagaaagugcacucaaugacacauggaagauggagaaagccuccuucauugaaguuaaaagcugccacuggccaaagucacacacccucuggagcaauggaguauuagaaagcgagaugauaauuccaaaaaauuuugccgggccagugucacaacacaacuacagaccagguuaccauacacaaacagcaggaccuuggcaucuaggcaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacucccuggucacagccggacaugggcagauugacaacuuuucacuaggagucuugggaauggcacuguuccuggaagaaaugcucaggacccgaguaggaacgaaacaugcaacacugcuaguugcagcaucuuuuguaacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuuuuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuaugugcucacuggacgaucggccgauuuggaacuggagagagcugccgauguaaaaugggaagaccaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauacucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaaguuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggacuuuaaggggaagacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccauuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaauccuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucuugguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggaaucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauugcaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgcgaggcuguugaagaugguagguuuugggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagaugaacugauugguagagcccgaauuucccagggagccggguggucuuugaaagagacggccuguuuggggaagucuuacgcccaaauguggacccugauguacuuccauagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6852 - RNA, 9876 nt, Artificial Sequence
  derived and/or modified CDS sequence (wt) from DENV-2__FJ850107__SS-prME
acagcaggcgugaucauuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaacugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggagggagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaauacaauaugaaggggacgguucuccauguaagaucccuuuugagauaacagacuuggaaaaaagacacgucuuaggucgccugauuacagucaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacagccugggacuuuggaucccugggaggaguguucacaucuauaggaaaggcucuccaccaaguuuucggagcaaucuacggggcugcuuuuaguggggucucauggaccaugaaaauccucauaggagucgucaucacauggauaggaaugaauucacgcagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucacgaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuauggcuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugugaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacucccuggucacagccggacaugggcagauugacaacuuuucacuaggagucuugggaauggcacuguuccuggaagaaaugcucaggacccgaguaggaacgaaacaugcaauacugcuaguugcaguaucuuuuguaacauugaucacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuggccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuuuuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauacucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaaguuagaaggagaauggaaggaaggagaggaaguccaaguccuggcauuggaaccuggaaaaaacccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccggaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagaccagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacauuaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaagcuuccaacuuucaugacucagaaagcaagaaacgcacuggacaacuuggcugugcugcauacggcugaggcagguggaagggcguacaaucaugcucucagugaacugccggagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuucuuggaaaaaaccaagaaagaccucggauugggaagcaucacaacccaggaaucugagagcaacauccuagacauagaucuacgcccugcaucagcauggacgcuguaugccguggccacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaauccuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucuugguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaagacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaaguugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgcgaggcuguugaagaugguagguuuugggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugauaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagaugaacugauugguagagcccgaauuucccagggagccggguggucuuugaaagagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauuaauugggcuaacaagcagggcuaccugggcgaagaacauccagacagcaauaaaucaagucagaucccuuauaggcaaugaggaauacacagacuacaugccauccaugaagagauucagaagggaagaggaagaggcaggcguccugugguag

SEQ ID NO: 6853 - RNA, 9876 nt, Artificial Sequence
  derived and/or modified CDS sequence (wt) from DENV-2__FJ850108__SS-prME
acagcaggcgugaucguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucacguacaaguguccucuccucagacaaaaugaaccagaggacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacacuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcaaaaaacaaaccaacauuggauuuugaacugauaaaaacagaagccaaacaaccugccacucugaggaaguacuguauagaagcaaagcugaccaacacaacgacagaaucgcguugcccaacacaaggggagcccagccuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcaaccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagacuugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucuuaagugcagacugagaauggacaaacuacagcucaaaggaaugucauacucuauguguacaggaaaguuuaaaauugugaaagaaauagcagaaacacaacauggaacaauaguuaucagaguacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauugguaggagucgugacacuguaccugggagcuauggugcaggcugauaguggcugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauuuuaucagaaaaugaggugaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaguugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccacacacaaauagcaggaccuuggcaucuagguaagcuugagauggacuuugauuucugcgaaggaacuacagugguggugacugaggacuguggaaauagaggacccucuuuaagaacaaccacugccucuggaaaacucauaacagaauggugcugccgauccugcacacuaccaccccuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagaaugaugguuauggugggcgcuaccaugacggaugacauagguaugggagugacuuaucuugcccuacuagcagcuuucaaaguuagaccaacuuuuguagcuggacuacucuugagaaaacugaccuccaaggaauuaaugauggcuaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuacgugcucacuggacgaucggcagauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagcuaucaaagcugagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcagggaaugauauagcagcuugucucaggaaaaauggaaagaaagugauacaacucaguaggaaaacuuuugacucugaguauguuaagaccagagccaaugauugggacuuuguggucacgacugacauuucagaaaugggugccaacuucaaagcugagaggguuauagaccccagacguugcaugaaaccaguuauacuaacagauggcgaagagcgggugauuuuggcaggaccuaugccagugacccacucuagugcagcgcaaagaagagggagaauaggaagaaauccaaaaaaugaaaacgaccaguacauauacaugggggaaccucucgaaaaugaugaagacugugcacauuggaaagaagcuaaaaugcuccuagacaacaucaacacacccgaaggaaucauucccaguauguucgagccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguauaaucaugcucucagugaacugccggagacccuggagacacugcuucuacugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagagaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaccugagagcaacauccuagacauagaucuacgcccugcaucagcauggacgcuguaugccguggcuacaacauuugucacaccaauguugagacauagcauugaaaauuccucagugaaugucucucuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacaguugauggaauaacagugauugaccuagaaccaauacccuaugauccaaaauuugaaaagcaguuaggacaaguaaugcuccuaauccuaugcgugacucaaguauuaaugaugagaacuacaugggcuuugugugaggcucuaaccuuagcgaccgggccuaucuccacacugugggaaggaaauccagggagguuuuggaacacuaccauugcagugucaauggcuaacaucuuuagagggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaauuccacgcaugaaauguacuggguaucuaaugccaccggaaacauagugucaucagugaauaugauuucaaggauguugauuaacagauucacaaugaaacacaagaaagccaccuacgagccagauguugacuuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccacggcagcuaugaaacaaaacaaacuggaucagcaucaucuauggugaacggaguggucagacugcugacaaaaccuugggacgucgucccuauggugacacagauggcaaugacagacacgacuccauucggacaacagcgcguuuuuaaagagaaaguagacacgagaacccaagaaccgaaagaaggcacaaagaaguugaugagaaucacggcagaguggcuuuggaaagaacuaggaaagaaaaagaccccuagaauguguaccagagaagaauucacaagaaaagugagaagcaacgcagccuugggggccauauucacugaugagaacaaauggaaaucggcacgugaggcuguugaagaugguagguuuugggaguugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaggaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauuuaaauuaacguaccaaaacaagguggugcgugugcaaagaccaacaccaagaggcacaguaauggauaucauaucgagaagagaccaaagaggcagugggcaagucggcaccuauggccucaauaccuucacuaauauggaagcccaauuaauuagacagauggagggagaaggaaucuucaaaagcauucagcaccugacagucacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccacuuucaugaguuagucaugaaagauggucgcgugcucguagucccaugcagaaaccaagaugaacugauugguagagcccgaauuucccagggagccggguggucuuugaaggaaacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauaccugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6854 - RNA, 9876 nt, Artificial Sequence
  derived and/or modified CDS sequence (wt) from DENV-2__JN819407__SS-prME
acagcaggcgugaucguuauguugauuccaacagcgauggcguuccauuuaaccacacgcaauggagaaccacacaugaucguugguaggcaggagaaagggaaaagucuucuguucaaaacagaggauggugucaacauguguacccucauggccauagaccuuggugaauugugugaagacacaaucacguacaaguguccucuccucagacaaaaugaaccagaggacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacgaugcgcuguauaggaauaucaaauagagacuucguggaagggguuucaggaggaagcuggguugacauagucuuagaacauggaaguugugugacgacgauggcaaaaaacaaaccaacauuggauuuugaacugauaaaaacagaagccaaacaaccugccacucugaggaaguacuguauagaagcuaagcugaccaacacaacgacagaaucgcguugcccaacacaaggggagcccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagacuugccauuaccauggcuaccuggagcggauacacaaggaucuaauuggauacagaaagagacauuggucacuuucaaaaauccccacgcgaagaaacaggaugucguugucuuagggucucaagaaggggccaugcacacggcacucacaggggccacagaaauccagaugucauuaggaaacuuacuguucacaggacaucucaagugcagacugagaauggacaaacuacagcucaaaggaaugucauacucuaugugcacaggaaaguuuaaaauugugaaagaaauagcagaaacacaacauggaacaauaguuaucagaguacaauaugaaggggacgguucuccauguaagaucccuuuugagauaacagacuuggaaaaaagacacgucuuaggucgccugauuacaguuaacccaaucguaauagaaaaagacagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauaguggcugcguugugagcuggaaaaauaaagaacugaaaugugguagcgggaucuucaucacagauaacguacacacauggacagaacaauauaaguuccaaccagaaucccccucaaaacuagcuucagcuauccaaaaagcucaugaagagggcauuuguggaauccgcucaguaacaagauuggagaaucugauguggaaacaaauaacaccagaauugaaucauauucuaucagaaaaugaggugaaguugaccauuaugacaggagacacuaaaggaaucaugcaggcaggaaaacgauccuugcggccccagcccacugaacugaaguacucauggaaaacauggggaaaggcgaaaaugcucuucacagagucucacaaucagaccuuucucauugauggcccugaaacagcagaaugccccaacacaaauagagcuuggaacucguuggaaguugaagacuaugguuuuggaguuuuuuccaccaauauauggcuaaaauugagagaaaaacaggauguauuuugugacucaaaacucaugucagcggccauuaaagacaacagagccguucaugccgauauggguuauuggauagaaagcgcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaucauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccccuaagauacagaggugaggauggaugcugguacgggauggaaaucagaccauugaaagagaaagaggagaauuuggucaacucuuuggucacagccggacaugggcagauugacaacuuuucacuaggaguuuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggauuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccgaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccggaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagcuaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaacgaccaguauauauacaugggggaaccccucgaaaaugaugaagacugugcacauuggaaagaagcuaaaaugcuccuggacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagagaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaccugagagcaacauccuggacauagaucuacgcccugcaucagcauggacgcuguaugccguggcuacaacauuugucacaccaauguugagacauagcauugaaaauucuucagugaaugucucucuuacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacaguugauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuagcaaccgggccuaucuccacacugugggaaggaaauccggggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauacaugcccucagucauagaaaaaauggaaacauuacaaaggaaauauggaggagccuuagugaggaauccacucucacgaaacuccacgcaugaaauguacuggguaucuaaugccaccggaaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccacggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaagguggacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauuuaaauuaacguaccaaaacaagguggugcgugugcaaagaccaacaccaagaggcacaguaauggauaucauaucgagaagagaccaaagaggcagugggcaagucggcaccuauggccucaauaccuucacuaauauggaggcccaauuaauuagacagauggagggagaaggaaucuucaaaagcauucagcaccugacagucacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccacuuucaugaguuagucaugaaagauggucgcgugcucguagucccaugcagaaaccaagaugaacugauugguagagcccggauuucccagggagccggguggucuuugaaggaaacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauaccugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6855 - RNA, 9876 nt, Artificial Sequence
  derived and/or modified CDS sequence (wt) from DENV-2__FJ898465__SS-prME
acagcaggcgugauuauuauguuaauuccaacagcaauggcguuccauuuaaccacacguaauggagaaccacacaugaucguugguaggcaagagaaaggaaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacuccacguccacauggguaacauaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaaaggccuugauuuuuauuuuacugacagcugucgcuccuucaaugacaaugcguuguauaggaauaucaaauagagacuucguagaagggguuucaggaggaagcuggguugacauagucuuagaacauggaaguugugugacgacgauggcaaagaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguuuacaugcaaaaagaacauggaaggaaaagucgugcugccagaaaaucuggaauacaccaucgugauaacaccucacucaggagaagagcacgccguaggcaaugacacaggaaaacauggcaaggaaaucaaaauaacaccacagaguuccaucacagaagcagaacugacaggcuauggcacugucacgauggagugcucuccgagaacgggucucgacuucaaugagauggugcugcugcagauggaagagaaagcuuggcuggugcacaggcaaugguuccuagaccugccgcuaccauggcuacccggagcggacacacaaggaucaaauuggauacaaaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugagggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggcuauuuuaggugacacagccugggauuuuggaucccuaggaggaguguuuacaucuauaggaaaggcucuccaccaagucuuuggagcaaucuauggggcugcuuuuaguggggucucauggacuaugaaaauccucauaggagucaucaucacauggauaggaaugaauucacgaagcaccucacugucugugucacuaguauuggugggagucgugacacuguaucugggagcuauggugcaggcugauagugguugcguugugagcuggaaaaacaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaaguugaccaucaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcggaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacauacccucuggagcaauggaguauuggaaagugaaaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggacggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaaugcugcuaguugcaguaucuuuugugacauugauuacugggaacauguccuuuagagaccugggaagagugaugguuauggugggcgcuaccaugacggaugacauagguaugggagugacuuaccuugcccuacuagcagcuuucaaaguuagaccaacuuucgcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugaggaauauggaaaacuaccaauuggcagugacuaucauggcuaucucgugugucccaaaugcagugauacugcuaaacgcauggaaggugaguugcacaauacuggcagcgguguccguuucuccauugcuuuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcaucuuagccaguucucuccuaaagaaugacauucccaugacagguccauuaguggcuggagggcuccuuaccguguguuacgugcucacuggacgaucggccgauuuggaacuggagagagcugccgauguaaaaugggaagaucacgcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaauuacggcagcagcaugguaccugugggaagugaagaaacaacgggcuggaguauugugggacguuccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaaguuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagcuauaaaacguggcuugagaacguuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauauauuucaacucgaguagaaaugggugaagcagcugggauuuucaugacagccacuccuccgggaaguagagacccguuuccucagagcaaugcaccaaucauggaugaggaaagagaaaucccugagcgcucguggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauucccaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuucgauggaauuaagaacaaccaaauacuggaagaaaacguggaaguggaaaucuggacgaaagaaggggaaaggaagaaauuaaaacccagaugguuggaugcuaggaucuauucugacccacuggcacuaaaagaauucaaggaguuugcagcuggaagaaaaucuuugacccugaaccuaaucacagaaauggguaggcuuccaacuuucaugacucagaaggcaagagacgcacuggacaacuuagcugugcugcauacggcugaggcaggugggagggcguacaaucaugcucucagugaacugccggagacccuggagacacugcuuuugcugacacuccuggccacagucacaggaggaaucuucuuauucuuaaugagcggaaaagguauagggaagaugacccugggaauguguugcauaaucacggcuaguauccucuuaugguaugcacagauacaaccacacuggauagcagcuucaauaauacuggaguuuuuucucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggauaucggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuaccauugcggugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaacauggucacaccagaagggaaggugguggaccucgguuguggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguuaugugacauaggggagucgucaccaaaucccacgauagaagcaggacgaacacucagaguccucaacuuaguggaaaauugguugaacaacaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccggaaacauagugucaucagugaacaugaucucaaggauguugauuaacagauucacaaugaaacacaagaaagccacuuacgagccagauguugaccuaggaagcggaacccgcaacauuggaauugaaagugagauaccaaaucuagacauaauaggaaaaagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagauacgacuccuuuuggacaacaacgcguuuucaaagagaaaguggacacgagaacccaagaaccgaaggagggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcugggcuacauuuuaagagacgugagcaagaaagaagggggagcaauguacgccgaugauacagcaggaugggacacaagaaucacacuagaagacuuaaaaaaugaagaaaugguaacaaaccacaugaaaggagaacacaagaaacuagccgaggccauauuuaaauuaacguaccaaaacaagguggugcgugugcaaagaccaacaccaagaggcacaguaauggauaucauaucgagaagagaccaaagaggcagcgggcaaguuggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcccuaaaugacauggggaaaguuaggaaagauauacaacaaugggaaccuucaagaggauggaacgacuggacacaagugccuuucuguucacaccauuuucaugaguuagucaugaaagauggucgcgugcucguagucccaugcagaaaucaagaugaacugauuggcagagcccgaauuucccagggagccggguggucucugaaggagacggccuguuugggaaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguauggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6856 - RNA, 9876 nt, Artificial Sequence
  derived and/or modified CDS sequence (wt) from DENV-2__FJ898466__SS-prME
acagcaggcgugauuguuauguugauuccaacagcgauggcguuccauuuaaccacacgcaauggagaaccacacaugauuguugguaggcaggagaaagggaaaagucuucuguucaaaacagaggaugguguuaacaugugcacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaagaauaaaccaacauuggauuuugaacugauaaaaacagaagccaaacaaccugccacucuaaggaaguacuguauagaagcaaagcugacuaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcaaccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaagaaauagcagaaacacaacauggaacaauaguuaucagaguacaauaugaaggggaugguucuccauguaagaucccuuuugagauaacagauuuggagaaaagacacgucuuaggucgccugauuacaguuaacccaaucguaacagaaaaagauagcccagucaacauagaagcagaaccuccauucggagacagcuacaucaucauaggaguagagccgggacaauugaaacuuaauugguuuaagaagggaaguuccaucggccaaauguucgagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguacuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaagagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagagugccccaacacaaacagagcuuggaacucgcuggaaguugaagacuaugguuuuggaguuuuuaccaccaacauauggcuaaaacugagagaaaaacaggauauauuuugugacucaaaacucaugucagcggccauuaaagauaacagagcaguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgagugggaacgaaacaugcaauacugcuaguugcaguaucuuuugugacauugauuacugggaacaugucuuuuagagacuugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugauggcccucaaaauagugagaaauauggaaaaauaccaauuggcagugacuaucauggcuauuucgugugucccaaaugcagugauacugcaaaacgcauggaaggugaguugcacaauauuggcagcgguguccgucucuccacugcucuuaacauccucacagcaaaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggccggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaacccggaauuuucagaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguaagagaagccauaaaacguggcuugagaacauuaauccuggcucccacuagagucguggcagcugaaauggaggaagcucuuagaggacuuccaauaagauaccaaaccccagccaucaaagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugacauagcagcuugucuuaggaaaaauggaaagaaagugauacaacucaguaggaagacuuuugacucugaauauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaacccaaaaaaugaaaaugaccaguauauauacaugggggaaccucucgaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaaucaagaacaaccaaauacuggaagaaaauguggaaguggaaaucuggacaaaagaaggggaaagaaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaacauccuggacauagaucuacgcccugcaucagcauggacgcuguaugccguggcuacaacauuuaucacaccaauguugagacauagcauugaaaauuccucagugaaugucucccuaacagccauugccaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugacuuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuccucuuuuccaucaugaaaaacacaacaaacacaagaagaggaacuggcaacauaggagagacacuuggagaaaaauggaaaagucgauuaaacgcacugggaaaaagugaauuucagaucuacaagaaaaguggaauccaggaaguggauagaacccuagcaaaagaaggcaucaaaagaggagaaacggaccaccaugcugugucgcgagguucagcaaaacugagaugguucgucgagagaaauauggucacaccggaagggaaggugguagaucucgguugcgguagggggggcuggucauacuauugcgggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugcgauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaaacauugcaaaggaaauauggaggagccuuagugaggaauccacuuucacgaaacuccacgcaugaaauguacuggguaucuaaugccaccgggaacauagugucaucaguaaacaugauuucaaggauguugauuaacagauucacaaugaaacacaagaaagccaccuacgagccagauguugaccuaggaaguggaacccgcaacauuggaauugagagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguagucagacugcugacaaaaccuugggacgucgucccuauggugacacagauggcaaugacagacacgacuccauuuggacaacagcgcguuuucaaagagaaaguagacacgagaacccaagaaccgaaggaaggcacgaagaagcugaugaaaaucacggcagaguggcuuuggaaagaacuaggaaagagaaagacaccuaggauguguaccagagaagaguucacaaaaaaagugagaagcaaugcagccuugggggccauauucacugaugagaacaaauggaaaucggcacgugaggcuguugaagauggcagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaauggugacaaaccacaugaaaggagaacacaagaaacuagccgaggccauauucaaauuaacguaccaaaacaagguggugcgugugcaaagaccaacaccaagaggcacaguaauggauaucauaucaagaagggaccaaagaggcagugggcaagucggcaccuauggccuuaauacuuucaccaacauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaagccaagaugaacugauugguagagcccgaauuucccagggagccggguggucuuugaaggagacggccuguuuggggaagucuuacgcccaaauguggacccugauguacuuccacagacgugaccucagacuggcggcaaaugcuauuugcucggcagucccgucacauuggguuccaacaagucgaacaaccugguccauacacgccaagcaugaauggaugacgacagaagacaugcuggcagucuggaacaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6857 - RNA, 9876 nt, Artificial Sequence
  derived and/or modified CDS sequence (wt) from DENV-2__FJ898467__SS-prME
acagcaggcgugaucauuauguugauuccaacagcgauggcguuccauuuaaccacacgcaauggagaaccacacaugaucguugguaggcaggagaaagggaaaagucuucuguucaaaacagaggaugguguuaacaugugcacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcucccucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccaagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaagaaauagcagaaacacaacauggaacaauaguuaucagaauacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacagccugggacuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauucaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacucccuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuauuauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauauuagccaguucucuccuaaaaaaugauauucccaugacaggcccauuaguggcuggagggcuucuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaaguuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaagggaaaaguugugggucuuuacgguaaugguguugucacaaggaguggagcauauguaagugcuauagcccagaccgaaaaaagcauugaagacaauccagagaucgaagaugacauuuuccggaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaaaggcguacaaucaugcucucagugaacugccggagacccuggagacacugcuucuauugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguugggacaaguaaugcuccuaauccuaugcgugacucaaguauuaaugaugaggacuacaugggcuuugugugaggcuuuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaaaaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucuugguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacgucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaaaaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacaaggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagaugaacugauugguagagcccgaauuucccagggagccggguggucuuugaaagagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6858 - RNA, 9876 nt, Artificial Sequence
  derived and/or modified CDS sequence (wt) from DENV-2__GQ868595__SS-prME
acagcaggcgugauuauuauguugauuccaacagcaauggcguuccauuuaaccacacgcaauggagaaccacacaugaucguuaguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugauauagucuuagaacauggaaguugugugacgacgauggcaaaaaauaaaccaacauuggauuucgaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguuuacaugcaaaaagaacauggaaggaaaagucgugcugccagaaaaucuggaauacaccaucgugauaacaccucacucaggagaagagcacgcuguagguaaugacacaggaaaacauggcaaggaaaucaaaauaacaccacagaguucuaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccauuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaauuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccaggacaauugaaacucaauugguuuaagaagggaaguuccaucggccaaauguuugagacaacaaugagaggagcgaaaagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaacaaagaacugaaauguggcagcgggaucuucauuacagacaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaaguugaccauuaugacaggagacauuaaaggaaucaugcaggcaggaaaacgaucuuugcggccucagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggagucuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaaucuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaccuugcccuacuagcagcuuuuaaaguuagaccaacuuucgcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucguguguuccaaaugcagugauacugcuaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcaugucacacguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccgggagcaggaaagacaaaaagauaccuuccagcuauaguuagagaagcuauaaaacguggcuugagaacauuaauccuggcucccacuagaguuguggcagcugaaauggaggaagcucuuagaggacucccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggauuuuaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugcuaacuucagggcugagaggguuauagaccccagacguugcaugaaaccagucauacuaacagauggcgaagagcgggugaucuuggcgggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugagggaaucauucccaguauguucgaaccagagcgugaaaagguggaugccauugauggugaauaccguuugagaggagaagcaaggaaaaccuuuguggaccuaaugagaagaggagacuuaccagucugguuggccuauagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaauuacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuauguagucauagccauccucacagugguggccgcaaccauggcaaaugagauggguuuccuggaaaaaaccaagaaagaccucggauugggaagcauuacaacccaggaaucugagagcaacauccuggacauagaccuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaaccagagaagcucaaaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaguuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccugggaagcggaacccgcaacauuggaauugaaagugagauaccaaaucuagacauaauaggaaaaagaauagagaaaauaaagcaagagcaugaaacaucauggcacuaugaccaagaccacccauacaaaacgugggcuuaccauggcagcuaugaaacaaagcaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugaugggaaaaagagagaagaagcuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgcugaugauacagcaggaugggacacaagaaucacacuagaagacuuaaaaaaugaagaaaugguaacaaaccacaugagaggagaacacaagaaacuagccgaggccauauucaaauuaacguaccaaaacaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuucaaaagcauuaagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccuuagacuggcggcaaaugccauuugcucggcagucccgucacacuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuugggaaaaagagaagaccaauggugcggcucauugauugggcuaacaagcagggccaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6859 - RNA, 9876 nt, Artificial Sequence
  derived and/or modified CDS sequence (wt) from DENV-2__GQ868540__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcugggucgacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguuuacaugcaagaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagagaaagccuggcuggugcacaggcaaugguuccuagaucugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagacagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaacaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuguugauggcccugaaacagcagaaugucccaacacaaacagagcuuggaacucgcuggaaguugaagacuaugguuuuggaguuuuuaccaccaauauauggcuaaaacugagagaaaaacaagauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacuggaaacauguccuuuagagaccugggaagagugaugguuauggugggcgcuaccaugacggaugacauagguaugggagugacuuaccuugcccuacuagcagcuuucaaaguuagaccaacuuucgcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauacugcuaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggcugauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacuuaucagaacgggauugcuggugaucucaggagucuuuccaguaucgauaccaaucacggcagcagcaugguaccugugggaagugaagaaacaacgggcuggaguauugugggacguuccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcuccuacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggauuuuaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagagcugagaggguuauagaccccagacguugcaugaaaccagucauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccgcuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacauggaaguggaaaucuggacaaaagaaggggaaaggaagaaauuaaaacccagaugguuggaugcuaggaucuauucugacccacuggcacuaaaagaauuuaaggaauuugcagcuggaagaaaaucucugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuauguagucauagcuauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugcuguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaacuagagaagcucagaaaagagcagcagcaggcaucaugaaaaacccaacaguugaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaauacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguucucaacccauauaugcccucagucauagaaaaaauggaaacgcuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggauacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgacuggacacaagugccuuucuguucacaccauuuucaugaguuagucaugaaagauggucgcgugcuuguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacaugcuaagcaugaauggaugacgacggaagacaugcuggcagucuggaauaggguguggauccaagaaaacccguggauggaagacaaaacuccaguggaaucaugggaagaaaucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6860 - RNA, 9876 nt, Artificial Sequence
  derived and/or modified CDS sequence (wt) from DENV-2__GQ868541__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagacacaaucacguacaaguguccccuccucaggcaaaaugaaccagaagacauagauuguuggugcaacucuacguccacauggguaacuuaugggacauguacuaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaacaaaccaacacuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaagagguucauuugcaaacacuccaugguagacagaggauggggaaauggauguggauuauuuggaaaaggaggcauugugaccugugcuauguuuacaugcaaaaagaacauggaaggaaaagucgugcugccagaaaaucuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuuuaaaaauccucacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacugcagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacagucaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguacuggugggagucgugacacuguaccugggagcuauggugcaggcugacagugguugcguugugagcuggaaaaacaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcuuuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggaguaauggaguauuggaaagugagaugauaauuccaaaaaauuuugccggaccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacucauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagagaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaccuugcccuacuagcagcuuucaaaguuagaccaacuuucgcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauacugcuaaacgcauggaaggugaguugcacaauauuggcagcgguauccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggccgauuuggaacuggagagagccgccgauguaaaaugggaagaucacgcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaaguuggaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuaugguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggauuuuaaagggaagacuguuugguuuguuccaaguauaaaagcaggaaaugacauagcagcuugccuuagaaaaaauggaaagaaagugauacaacucaguaggaagacuuuugacucugaguauguuaagacuagagccaaugauugggauuuuguggucacaacugacauuucagaaaugggugccaacuucagggcugagaggguuauagaccccagacguugcaugaaaccagucauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguuugaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacgaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacaguaguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaucaagccacagugcuaaugggucuuggaaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuaccauugcagugucaauggcuaacaucuuuagggggagcuaccuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugcgggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagacguugaccuaggaagcggaacccgcaacauuggaauugaaagugagauaccaaaucuagacauaauaggaaagagaauagagaaaauaaagcaagagcaugaaacaucauggcaccaugaccaagaccacccauacaaaacgugggcuuaccauggcagcuaugaaacaaaacaaacuggaucagcaucaucuaugguaaacggaguggucagacugcugacaaaaccuugggacgucgucccuauggugacacagauggcaaugacagacacgacuccuuuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagcgggcaggucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcccuaaaugacaugggaaaaguuaggaaagauauacaacaaugggaaccuucaagaggauggaacgacuggacucaagugccuuucuguucacaccauuuucaugaguuagucaugaaagauggucgcgugcucguagucccaugcagaaaccaagaugaacugauuggcagagcccgaauuucccaaggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucucuuauaggcaaugaggaauacacagacuacaugccauccaugaagagauucagaagggaagaggaagaggcagguguccugugguag

SEQ ID NO: 6861 - RNA, 9876 nt, Artificial Sequence
  derived and/or modified CDS sequence (wt) from DENV-2__GQ868603__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagacacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguuccucugcaaacacuccaugguagacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggacuuggaaaaaagacacgucuuaggucgccugauuacaguuaacccaaucguaacagaaaaagauagcccagucaacauagaagcagaaccuccauucggagauagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaauuaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaacauauggcuaaaauugagagaaaaacaggauguacuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuagcugcaguaucuuuugugacauugauaacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauugguagugacuaucauggcuaucucgugugucccaaaugcagugauauugcaaaacgcauggaaggugaguugcacaauauuggcagcgguguccguuucuccacugcucuuaacauccucacggcagaaggcggauuggauaccacuggcauugacgauaaaaggucucaauccaacagccauuuuucuaacaacucucucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagggggaagaggauugaaccaucaugggcagacgucaagaaagaccuaauaucauauggaggaggcuggaagcuagaaggagaauggaaggaaggagaggaaguccaaguccuggcauuggaaccuggaaaaaauccaagagccguccaaacgaaaccuggacuuuucaaaaccaacaccggaaccauaggugccguaucucuggacuuuuccccuggaacgucaggaucuccaauugucgacagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucauuauggacgaagcccacuucacagacccagcaaguauagcagcgagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuagcauguucgaaccagagcgugaaaagguggaugccauugauggugaauaccguuugagaggagaagcaaggaaaaccuuuguggacuuaaugagaagaggggacuuaccagucugguuggccuacagaguggcagcugaaggcaucaacuacgcagacagaaggugguguuuugauggaaucaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguguagggaagaugacccuggggauguguugcauaauuacggcuaguauccuccuaugguaugcacagauacaaccacacuggauagcagcuucaauaauacuggaguucuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaacauccuggacauagaucuacguccugcaucagcauggacgcuguaugccguggcuacaacauuuuucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuacucacaagucaacccuauaacucucacagcagcucuucucuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcucugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggaguccucaccaaaucccacgauagaagcaggacgaacacucagaguccucaacuuaguggaaaauugguugaacaacaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgaaccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccauggcagcuaugaaacaaaacaaacuggaucagcaucauccauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcuuuggaaagaacuaggaaagaaaaaaauaccuaggauguguaccagagaagaauuuacaagaaaggugagaagcaaugcagccuugggggccauauucacugaugagaacaaauggaaaucggcacgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaaggaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaacacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguagaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6862 - RNA, 9876 nt, Artificial Sequence
  derived and/or modified CDS sequence (wt) from DENV-2__FJ898450__SS-prME
acagcaggcgugauuaucauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacuccacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucugaaugaagagcaggacaaaagguucaucugcaaacacuccaugguagacagaggauggggaaauggauguggauuauuuggaaaaggaggcauugugaccugugcuauguuuacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaacgagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuucaguggggugucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccaucaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggaugcauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacucuuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauaggcaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuaucucgugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccguuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaauuacggcagcagcaugguaccugugggaagugaaaaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucagggcaugaaugggucacggauuuuaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaguaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcucugugugaggcucuaaccuuagcgaccgggcccaucuccacacugugggaaggaaauccagggagguuuuggaacacuaccauugcagugucaauggcuaacaucuuuagagggagcuacuuggccggagcuggacuucucuuuuccaucaugaagaacacaacaaacacaagaagaggaacuggcaacauaggagagacacuuggagaaaaauggaaaagccgauuaaaugcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacagaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacgccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagaugugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguagugcgugugcaaagaccaacaccaagaggcacaguaauggauaucauaucgagaagagaccaaagaggcagcgggcaagucggcaccuauggccuuaauacuuucaccaacauggaagcccaauuaauuagacagauggagggagaaggaaucuuuaaaagcauucagcaccugacagucacagaagaaaucgcuguacagaacugguuagcgagaguagggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6863 - RNA, 9876 nt, Artificial Sequence
  derived and/or modified CDS sequence (wt) from DENV-2__FJ898453__SS-prME
acagcaggcgugauuguuauguugauuccaacagcgauggcguuccacuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccccuccucagacaaaaugaaccagaagacauagauuguuggugcaacucuacguccacauggguaacuuaugggacauguaccaccacaggagaacauagaagagaaaaaagaucaguggcgcucguuccacauguggguaugggacuggagacacgaacugaaacauggaugucaucagaaggggccuggaagcauguucagagaauugaaaccuggaucuugagacauccaggcuuuaccauaauggcagcaauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaaccuccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucugucagaaaaugagguaaaguugaccauuaugacgggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuuccaccaauauauggcuaaaauugagagaaagacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaggagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugaugguccucaaaauagugagaaauauggaaaaauaccaauuagcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagucuauagaaucaagcaaagagggauucuuggauauucucagauuggagccggaguuuacaaagaaggaacauuccacacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguaggaggaagggcguacaaucaugcucucagugaacugccggagacccuggagacacugcuucuacugacacuccuggcaacagucacaggaggaaucuuuuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguucugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucgcaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaagugggguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacgguguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuaggauguguacuagagaagaauucacaagaaaagugagaagcaaugcagccuugggugccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucggcaccuauggccuuaauacuuucaccaauauggaagcccaauuaauuagacagauggaaggagaaggaaucuucaaaagcauucagcaccugaccgucacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuuuuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacucugauguacuuccacagacgugaccucagauuggcggcaaaugccauuugcucggcagucccgucacauuggguuccgacaagucgaacaaccugguccauacacgccaagcaugaauggaugacgacggaagacaugcuggcagucuggaacaggguguggauccaagaaaacccauggauggaagacaagacuccaguggaaucaugggaagaagucccauaccuggggaaaagggaagaccaauggugcggcucauugauugggcuaacaagcagggcuaccugggcaaagaacauccagacagcaauaaaucaagucagaucccuuauaggcaaugaggaauacacagacuacaugccauccaugaagagauucagaagggaagaggaagaggcagguguccugugguag

SEQ ID NO: 6864 - RNA, 9876 nt, Artificial Sequence
  derived and/or modified CDS sequence (wt) from DENV-2__EU482445__SS-prME
ucggcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacgcuggauuucgaacugauaaaaacggaagccaaacagccugccacccuaagaaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggaguguuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcgaagagaauggccauuuugggugacacagccugggacuuuggaucccugggaggaguguuuacaucuauaggaaaagcucuccaccaagucuuuggagcaaucuauggagcugccuucagugggguuucauggaccuugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacgacagagugcccuaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugcugacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggauggguguugguacgggauggaaaucagaccauugaaagagaaagaagaaaaucugguuaacuccuuggucacagccggacaugggcagguugacaauuuuucacugggagucuugggaauggcauuguuucuggaggaaaugcuuaggacacgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccagguguuggcacuggagccuggaaaaaauccaagagccguccaaacaaaaccuggucuuuucaaaaccaacaccggaacaauaggagccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagcuacucccccgggaaguagagauccauuuccucagagcaaugcaccaaucauagaugaagaaagagaaaucccugaacguucauggaauacuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguauguuaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggauuuuuuuauucuugaugagcgggaggggcauagggaagaugacccugggaaugugcugcauaaucacggcuagcauccuucuaugguacgcacaaauacagccacacuggauagcagcuucaauaauacuggaauuuuuucucauaguuuugcucauuccagaaccagaaaaacagagaacaccccaagacaaccaauugaccuacguuguaauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccguugauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuuuuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguaguuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuaggcuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggaguuuuuaaaaacauccagcaccugacagucacagaagaaguugccgugcaaaacugguuggcaagaguggggcgcgaaagguugucaagaauggccaucaguggagaugauuguguugugaaaccuuuagaugacagguuugcaaacgcuuugacagcccuaaaugacaugggaaagauuagaaaagauauacaacaaugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaacuuggucuauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6865 - RNA, 9876 nt, Artificial Sequence
  derived and/or modified CDS sequence (wt) from DENV-2__EU482446__SS-prME
ucggcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguugguguaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacgcuggauuucgaacugauaaaaacggaagccaaacagccugccacccuaagaaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggaguguuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaauuccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcgaagagaauggccauuuugggugacacagccugggacuuuggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacgacagagugcccuaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugcugacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuucuggaggaaaugcuuaggacacgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuucccauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccagguguuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagcuacucccccgggaaguagagauccauuuccucagagcaaugcaccaaucauagaugaagaaagagaaaucccugaacguucauggaauacuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguauguuaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggauuuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuacguuguaauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuccaagcaaaagcaaccagagaagcccagaaaagagcagcggccggcaucaugaaaaacccaaccguugauggaauaacagugauugaucuggauccaauaccuuaugauccaaaguuugaaaagcaguugggacaaguaaugcuacuaauccucugcgugacucaaguguugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaauauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuuuuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguaguuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuaggcuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguuggcaccuauggacucaauacuuucaccaauauggaagcccaauuaaucagacagauggagggagaaggaguuuuuaaaaacauccagcaccugacagucacagaagaaguugccgugcaaaacugguuggcaagaguggggcgcgaaagguugucaagaauggccaucaguggagaugauuguguugugaaaccuuuagaugacagguuugcaaacgcuuugacagcccuaaaugacaugggaaagauuagaaaagauauacaacaaugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaacuuggucuauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6866 - RNA, 9876 nt, Artificial Sequence
  derived and/or modified CDS sequence (wt) from DENV-2__EU482448__SS-prME
ucggcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucugcugacagcugucgcuccuucaaugacaaugcguugcauaggaauaucaaauagagacuucguagaagggguuucaggaggaaguuggguugacauagucuuagaacauggaagcugugugacgacgauggcaaaaaacaaaccaacgcuggauuucgaacugauaaaaacggaagccaaacagccugccacccuaagaaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggaguguuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcgaagagaauggccauuuugggugacacagccugggacuuuggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucucuacagagucuuauaaccaaaccuuucucauugauggccccgagacgacagagugcccuaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugcugacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuucuggaggaaaugcuuaggacacgaguaggaacgaaacaugcaauacuacuaguugcaguuucuuuugugacauugaucacagggaacauguccuucaaagaccuaggaagaguggugguuaugguaggcgcuacaauggcggaugacauagguaugggugugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccagguguuggcacuggagccuggaaaaaauccaagagcuguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagcuacucccccgggaaguagagauccauuuccucagagcaaugcaccaaucauagaugaagaaagagaaaucccugaacguucauggaauacuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguauguuaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggauuuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuacguuguaauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccguugauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuuuuucaucccgccagaaaagugugacacauuguugugugauauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaauaucauggcacuacgaccaagaucacccauacaaaacgugggcauaccaugguaguuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuaggcuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggaguuuuuaaaaacauccagcaccugacagucacagaagaaguugccgugcaaaacugguuggcaagaguggggcgcgaaagguugucaagaauggccaucaguggagaugauuguguugugaaaccuuuagaugacagguuugcaaacgcuuugacagcccuaaaugacaugggaaagauuagaaaagauauacaacaaugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaacuuggucuauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6867 - RNA, 9876 nt, Artificial Sequence
  derived and/or modified CDS sequence (wt) from DENV-2__EU482449__SS-prME
acagcaggcgugauuauuauguugauuccaacagcgauggcguuccaucuaaccacacguaauggagaaccacacaugaucguugguagacaagagaaagggaaaagucuucuguucaaaacggaggauggugugaacauguguacccucauggccauagaucuuggugaauugugugaagauacaaucacguacaagugcccccuccucaggcagaaugaaccagaagacauagauuguugguguaacuccacguccacauggguaacuuaugggacgugcaccaccacaggagaacacagaagagaaaaaagaucaguggcacucguuccacauguggguaugggacuggagacacgaacugaaacauggaugucgucagaaggagccuggaaacacgcucagagaauugaaaccuggaucuugagacauccaggcuuuaccauaauggcagcaauccuggcauacaccauaggaacgacacauuuccaaagggcccugauuuucaucuuacugacagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacagaagccaaacaaccugccacuuuaaggaaguacuguauagaagcaaagcugaccaacacaacaacagaaucucguugcccaacacaaggggaacccagucuaaaugaagagcaggacaaaagguucgucugcaaacacuccaugguggacagaggauggggaaauggauguggauuauuuggaaagggaggcaucgugaccugugcuauguuuacaugcaaaaagaacauggaaggaaaaaucgugcagccggaaaauuuggaauacaccaucgugauaacaccucacucaggagaagagcaugccguagguaaugacacaggaaaacaugguaaggaaaucaaaauaacaccacagaguuccaacacagaagcagaacugacaggcuauggcacaguuacgauggagugcucuccgagaacgggccuugauuuuaaugagauggugcugcugcagauggaagacaaagcuuggcuggugcacaggcagugguuccuagaccugccguuaccauggcuacccggagcggacacacaaggaucaaauuggauacagaaagagacacuggucaccuucaaaaauccucacgcgaagaaacaggaugucguuguuuuaggaucucaagaaggggcaaugcacacggcacucacaggggccacagagauccagaugucaucaggaaacuuacuauucacaggacaucucaagugcaggcugagaauggacaaacuacagcucaaaggaaugucguacucuaugugcacaggaaaguucaaaauugugaaggaaauagcagaaacacaacauggaacaauaguuauuagaguacaauaugaaggagacggcucuccauguaagaucccuuuugaaauaauggauuuagaaaaaagacauguuuuaggucgccugauuacaguuaacccgaucguaacagaaaaagauagcccagucaacauagaagcagaaccuccauucggagacagcuacaucauuauaggaguagagccgggacaauugaaacucaacugguuuaagaaaggaaguuccauuggccaaauguuugagacaacaaugagaggagcgaagaggauggccaucuuaggugacacagccugggauuuuggaucccuaggaggaguguuuacaucuauaggaaaagcucuccaccaaguuuucggagcaaucuauggggcugccuuuaguggggucucauggacuaugaaaauccucauaggagccaucaucacauggauaggaaugaauucacguagcaccucacugucugugucacuaguauuggugggagucauaacacuguacuugggagccauggugcaggcugauagugguugcguugugagcuggaaaaacaaagaacugaaauguggcagcgggaucuucaucacagauaacgugcacacauggacagagcaauacaaguuccaaccagaauccccuucaaaauuagcuucagcuauccagaaagcucaugaagagggcauuugugggauucguucaguaacaagauuggagaaucugauguggaaacaaauaacaccagaauugaaccacauucuaucagaaaaugagguaaaguugaccaucaugacaggagauauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuauggcuuuggaguuuucaccaccaacauauggcuaaaauugagagaaaaacaggauguguuuugugacucaaaacucaugucagcagccauaaaagacaacagagccguccaugccgauauggguuacuggauagaaagugcacucaaugacacauggaagauggaaaaggccuccuucauugaaguuaaaagcugccacuggccaaagucacacacccucuggagcaauggaguauuagaaagugagaugauaauuccaaaaaguuuugcugggccagugucacaacacaacuacagaccaggcuauuacacgcaaacagcaggaccuuggcaucuagguaagcuugaaauggacuucgauuucugcgaaggaacuacagugguggugacugaggacugcggaaauagaggacccucuuuaagaacgaccacugccucuggaaaacuuauaacagaauggugcugccgauccugcacauuaccaccucuaagauacagaggugaggauggaugcugguaugggauggaaaucagaccauuaaaagagaaagaagagaauuuggucaacuccuuggucacagcaggacaugggcagauugacaacuucucacuaggagucuugggaauggcacuauucuuggaagaaaugcucaggacacgaguaggaacgaaacaugcaauacugcuaguugcaguuuccuuuaugacauugauuacugggaacauguccuuuagagaccugggaagagugaugguuauggugggcgcuaccaugacggaugacauagguaugggagugacuuaucuugcccuacuagcagcuuucaaaguuagaccaacuuucgcagcuggacuacuacugagaaagcugaccuccaaggaauuaaugauggcuaccauaggaauugcacuccuuucucaaagcaccauaccagagaccauucuugaacuaacugaugcguuagccuugggcaugaugguccuaaaaauagugagaaauauggaaaaguaccaauuggcagugacuaucauggcuaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccaucuuucuaacaacucuuucgagaaccagcaagaaaaggagcuggccgcuaaaugaggcuaucauggcugucgggauggugagcauuuuagccaguucccucuuaaaaaaugacauucccaugacagguccauuaguggcuggagggcuccuuacugugugcuacgugcucacuggacgaucggccgauuuggaacuggagagagccaccgaugucaaaugggaagaucaggcagaaauaucaggaagcagcccaauccugucaauaacaauaucagaagauggcagcaugucgauaaagaaugaagaggaagaacaaacacugaccauacucaucagaacgggauugcuagugaucucaggacucuuuccagugucaauaccaauuacggcagcagcaugguaccugugggaagugaagaaacaacgggcuggaguauugugggacgucccuucacccccacccgugggaaaggcugaacuggaagauggagccuauagaaucaagcagaaagggauucuuggauacucccagauuggagccggaguuuacaaagaaggaacauuccauacaauguggcacgucacacguggcgcuguucugaugcauagagggaagaggauugaaccaucaugggcggacgucaagaaagaccuaauaucauauggaggaggcuggaaacucgaaggagaauggaaggaaggagaggaaguccaaguccuggcauuggaaccuggaaaaaauccaagagcuguucaaacgaaaccuggacuuuucaaaaccaacaccggaaccauaggcgccguaucucuggacuuuucuccuggaacgucaggauccccaauugucgacagaaaaggaaaaguugugggucuuuauggcaaugguguugucacaaggaguggagcauacgugagugcuauagcccagaccgaaaaaagcauugaagacaauccagagauugaagaugacauuuuccgaaagaaaagauugacuaucauggaccuccauccaggagcgggaaagacaaaaagauaccuuccagccauaguuagagaagccauaaaacguggcuuaagaacauuaauccuagcccccacuagagucguggcagcugaaauggaggaagcucuuagaggacuuccaauaagauaccaaaccccagccaucagagccgagcacaccgggcgggagauuguggaccuaaugugucaugccacguuuacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccgggaaguagagacccauuuccucagagcaaugcaccaaucauagaugaggaaagagaaaucccugagcguucguggagcucuggacaugaaugggucacggauuuuaaagggaagacuguuugguuuguuccaaguauaaaagcgggaaaugacauagcagcuugucucaggaaaaauggaaagaaagugauacaacucagcaggaagaccuuugacucugaguauguuaagacuaggaccaaugauugggacuuuguggucacaaccgacauuucagaaaugggugcuaacuucaaggcugagaggguuauagaccccagacguugcaugaaaccaguuauacuaacagauggugaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcgcauuggaaagaagcuaaaaugcuccuagauaacaucaacacaccugaaggaaucauuccuaguauguucgaaccagagcgugaaaagguggaugccauugauggugaauaccgcuugagaggagaagcaaggaaaaccuuuguggaccuaaugagaagaggggacuuaccagucuggcuggccuacagaguggcagcugaaggcaucaacuacgcagacagaaggugguguuuugauggaguuaagaauaaccaaauacuggaagaaaacguggaaguggaaauuuggacaaaagagggggaaaggaagaaauuaaaacccagaugguuggacgcuaggaucuauucugacccacuggcacuaaaagaauucaaggaauuugcagcuggaagaaagucccuaacccugaaccuaaucacagaaauggguaggcuuccaacuuucaugacucaaaaagcaagagaugcacuggauaaccuagcugugcugcauacggcugaggcagguggaagagcguacaaucaugcucucagugaacugccggagacccuggagacacugcuuuuacugacacuucuggcuacagucacgggaggaaucuucuuauucuuaaugagcggaaaagguguagggaagaugacccugggaauguucugcauaaucacggcuagcauccuccuaugguaugcacagauacaaccacacuggauagccgcuucaauaauacuggaguuuuuucucauaguuuugcucauuccagaaccagaaaaacagagaacaccccaagauaaccaauugaccuacguugucauagccauccucacaguaguggccgcaaccauggcaaacgaaauggguuuucuggaaaaaaccaagaaagaccucggacugggaagcauugcaacucaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuccuugccauuggauguuacucacaagucaaccccauaacucucacagcagcucuucuuuuauugauagcacauuaugccauuauagggccaggacuucaagcgaaagcaaccagagaagcucagaaaagagcagcagcaggcaucaugaaaaacccaacagucgauggaauaacagugaucgaccuagauccaauacccuaugauccaaaauuugaaaaacaguuaggacaaguaaugcuccuaauucucugcgugacucaaguauuaaugaugaggacuacaugggcucugugugaggcucuaaccuuagcgaccgggcccaucuccacauugugggaaggcaauccagggagguuuuggaacacuaccauugcagugucaauggcuaacauuuuuagagggagcuacuuggcuggagcuggacuucuuuuuuccaucaugaagaauacaacaaauacaagaagaggaacuggcaacauaggagagacgcuuggagagaaauggaaaagccgauugaacgcacugggaaaaagugaauuucagauuuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugugguagagggggcuggucauacuauugugggggacuaaagaauguaagagaagucaaaggccugacaaaaggaggaccaggacacgaggaaccuauccccaugucaacauauggguggaaucuaguacgucugcagaguggaguugauguuuucuucacuccgccagaaaagugugacacacuguugugugacauaggggagucgucaccaaaucccacgauagaagcaggacgaacacucagaguccucagcuugguggaaaauugguugaacaaugacacucaauuuugcauaaagguucucaacccauacaugcccucaguuauagaaaaaauggaaacacugcagaggaaauauggaggagccuuagugaggaauccacucucacgaaacuccacacaugagauguacuggguauccaaugcuacugggaacauagugucaucagugaacaugauuucaaggaugcugauuaacagauucacaaugaaacacaagaaagccaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauauaaaacaugggcuuaccauggcagcuaugaaacaaaacagacuggaucagcaucauccauggugaacggaguggucagacuacugacaaaaccuugggacgucgucccuaugguaacacagauggcaaugacagauacgaccccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggagccauauucacugaugagaacaaauggaagucggcacgcgaggcuguugaagauaguagguuuugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuucuuggaguuugaagcccugggauucuugaaugaagaucacugguucucuagagagaacucccugaguggaguggaaggagaagggcugcacaagcuaggcuacauucuaagagacgugagcaagaaggaaggaggagcaauguacgccgaugauacagcaggaugggacacaagaaucacacuagaggacuuaaaaaaugaagaaauggugacaaaccacauggaaggagaacacaagagacuagccgaggccauauuuaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcucaauuaauuagacagauggagggagaaggaauuuucaaaagcauucagcaccugacagucacagaagaaaucgcuguacagaacugguuggcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucaaaaggauggaacgauuggacacaagugccuuucuguucacaccauuuucaugaguuaaucaugaaagacggccgcgugcuugugguuccaugcagaaaccaagaugaacugauuggcagggcccgaauuucucagggagcuggguggucuuugaaagagacugccuguuuggggaagucuuacgcccaaauguggagccugauguacuuccacagacgugaccucaggcuggcggcaaaugcuauuugcucggcagucccgucacauuggguuccuacaagucgaacaaccuggucuauacacgccaaacaugaauggaugacgacggaagacaugcugacagucuggaacaggguguggauccaagaaaacccauggauggaagacaaaacuccaguggagucaugggaggaagucccauauuugggaaaaagagaagaccaauggugcggcucauugauugggcuaacaagcagggcuaccugggcaaagaacauccaaacagcaauaaaucaagucagaucccuuauaggcaaugaagaauacacagauuacaugccauccaugaagagauucagaagggaagaggaagaggcagguguccugugguag

SEQ ID NO: 6868 - RNA, 9876 nt, Artificial Sequence
  derived and/or modified CDS sequence (wt) from DENV-2__EU482450__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauaguuuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucauuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauucgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaucaaacuuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaggugaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguucuuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaaugacggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaagugcuauaccagagaccgugcuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaacuaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcauuaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagccacagggcccaucuccacacugugggaaggaaacccaggaagguucuggaacacuaccauagcggugucaauggcuaacaucuuuagagggaguuacuuggcuggagcuggacuucucuuuuccauuaugaagaacacaaccaauacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacguacacucagaguccuuaauuuaguagaaaauugguugaacaacaacacucaauuuugcauaaaaguucucaauccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagagaagaagcuaggggaauucggcaaggcaaaaggcagcagagccauaugguacauguggcuuggagcucgcuuccuggaguuugaagcccuaggauuccuaaaugaagaccacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugaaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaaugauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaagaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacgcagauuacaugccauccaugaaaagauucagaagagaagaggaagaagcaggaguccugugguaa

SEQ ID NO: 6869 - RNA, 9876 nt, Artificial Sequence
  derived and/or modified CDS sequence (wt) from DENV-2__EU569721__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacauguguacccucauggcuauggaucuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuaucaugacaggagacaucaaaggaaucaugcaggcaggaaaacgauccuugcggccucagcccacugagcugaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucugcggccauaaaagacaacagagccguccaugccgacauggguuacuggauagaaagugcacucaaugacacauggaagauagagaaagccucuuucauugagguaaaaaacugccacuggccgaaaucacacacccucuggaguaauggagugcuagaaagugagaugauaaucccaaagaaucucgcuggaccagugucucaacacaauuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuugguuacagccggacaugggcagguugacaauuuuucacugggagucuugggaauggcauuguuccuggaggaaaugcuuaggacccgaguaggaacgaaacaugcaauacuacuaguugcaguuucuuuugugacguugaucacagggaacauguccuucaaagaccuaggaagaguggugguuaugguaggcgccacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauuaacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucaccccuacccaugggaaaggcugaacuggaagauggagccuacagaaucaagcaaaaagggauucuuggguauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacaucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagaaaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaauuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacaucucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaagaaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauuaguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaacaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucguuuccuggaguuugaagcccuaggauuccuaaaugaagaucacugguucucuagagagaacucccugaguggaguggaaggagaagggcugcacaagcuagguuacauucuaagagacgugagcaagaaagagggaggagcuauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaacccuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaagcaugaauggaugacaacggaagacauguugacggucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6870 - RNA, 9876 nt, Artificial Sequence
  derived and/or modified CDS sequence (wt) from DENV-2__EU482451__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacaggagcagaauugacagguuauggcaccgucacgauggagugcuccccgagaacaggccucgacuucaaugagaugguguugcugcagauggaaaauaaagcuuggcugguccauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacuauagucaucagagugcaauaugaaggggacggcucuccauguaaaaucccuuuugaaauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucgucacagacaaugugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauuuuagcagaaaaugaggugaaguugacuauuaugacaggagacauuaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacgguuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacacuaccaccccuaagauacagaggugaggaugggugcugguacgggauggaaaucagaccauugaaagagaaagaagaaaaucugguuaacuccuuggucacagccggacaugggcagguugacaauuuuucacugggaguccugggaauggcauuguucuuggaggaaaugcuuaggacccgaguaggaacgaaacaugcaauacuacuaguugcaguuucuuuugugacacugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuucugacauccucacagcaaaaaacggauuggauaccauuagcauugacaaucaagggucucaauccaacagcuauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggugcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccugggaaaaauccaagagccguccaaacaaaaccuggucuuuucaaaaccagcaccggaacaauaggugccguaucucuggacuuuuccccuggaacgucaggaucuccaauuaucgacaaaaaaggaaaaguugugggucuuuaugguaaugguguugucacaaggaguggagcauauguaagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcacauuucacagacccagcaaguauagcagcuagaggauacaucucaacccgaguggaaaugggugaggcagcugggauuuucaugacagccacucccccgggaagcagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuaaaaccaaugacugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaucguuugagaggagaagcaaggaaaaccuuuguggacuuaaugaggagaggagacuuaccagucugguuggcuuacaaaguggcagcugaaggcaucaacuaugcagacagaaggugguguuuugaugggauuaagaacaaccaaauccuggaagaaaauguggaaguugaaaucuggacaaaagaaggggaaaggaagaaauugaaacccagaugguuggaugccaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggaggaaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucgucacaccaaugcugagacauagcauugagaauuccucagugaauguaucccuaacagcuauagccaaccaagcaacaguguuaaugggucuagggaagggauggccauugucaaagauggacaucggaguuccccuucucgccauuggauguuacucacaagucaaucccauaacucucacagcagcucuccucuuauugguagcgcauuacgccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccaucgcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaccuacaagaaaaguggaauccaggaaguggauagaaccuuagcaaaagaaggcaucaaaagaggagaaacggaccaucacgcugugucgcgaggcucggcaaaacugagaugguucguugagagaaacauggucacaccagaagggaaaguaguggaccucgguuguggcagaggaggcuggucauacuauugcggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucuggaaacauagugucaucggugaacaugauuucaaggauguugaucaauagauucacaaugagacacaagaaagccacuuacgagccggauguugaccucggaagcggaacccgaaacauuggaaaugaaagugaaauaccaaaccuagacauaauugggaaaagaauagaaaaaauaaagcaagagcaugaaacaucauggcacuacgaccaagaccacccauacaaaacgugggcauaucaugguagcuaugaaacaaaacagacuggaucagcaucauccauggucaauggaguggucaggcugcugacaaaaccuugggacguccucccuacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaagcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccagagagguagugggcaaguuggcaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugacuguguugugaaaccuuuagacgacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucgugugcuuguuguuccauguagaaaccaagaugaacugauuggcagagcccgaaucucccaaggagcaggguggucuuugcgggagacggcuuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaaugguguggcucauugauuggguuaacaagcagggccacaugggcaaagaacauccaaguagcaauaaaucagguuagaucucuuauaggcaaugaggaauacacagauuacaugccauccaugaaaagauucagaagagaagaggaagaagcaggaguccugugguaa

SEQ ID NO: 6871 - RNA, 9876 nt, Artificial Sequence
  derived and/or modified CDS sequence (wt) from DENV-2__EU660413__SS-prME
ucugcaggcaugaucauuaugcugauuccaacagugauggcguuucaucuaaccacacgcaacggagaaccacacaugaucgucgguauacaggagaaagggaaaagucuucuguucaaaacagaggauggagugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacacagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagccgucgcuccuucaaugacaaugcguugcauaggaauaucaaauagagacuuuguggaagggguuucaggaggaaguuggguugacauagucuuagaacauggaagcugugugacgacgauggcaaaaaacaaaccaacacuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaacugacagguuauggcaccgucacgauggaguguuccccgagaacaggcuucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucaccuucaaaaauccccaugcgaagaaacaggauguuguuauuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcgaagagaauggccauucugggugacacagccugggacuucggauccuugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccugauguggaaacaaauaacaccagaauugaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauaggggacccucuuugagaacaacuacugccuccggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauaggaaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaguccaacagccauuuuucuaacgacccucucaagauccaacaagaaaagaagcuggccacuaaaugaggcuaucauggcagucggaauggugagcauuuuagccaguucccuccuaaaaaaugauauucccaugacaggaccacuaguggcuggagggcuccucacuguguguuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugaaugggucacggauuuuaaagggaagacuguuugguucguuccaagcauaaaagcaggaaaugauauagcagcuugccugagaaaaaauggaaagaaaguaauacaacucaguaggaagacuuuugauucagaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagcaggaagaaagucucugacccugaaccuaaucacagaaauggguaggcuuccaacauucaugacucagaagacaagagacgcacuggacaaccuagcagugcugcacacggcugaagcagguggaagggcguacaaccacgcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuuacuuauuccagaaccagaaaaacagagaacaccccaagacaaccaauugaccuacguugucauagccauccucacagugguggccgcaaccauggcaaacgagauggguuuucuagaaaaaacgaagaaagaucuuggauuaggaggcauugcaacccagcaacccgagagcaacauccuggacauagaccuacgucccgcaucagcuuggacgcuguaugccguggcuacaacauucguuacaccaaugcugagacacagcauugagaauuccucagugaauguauccuuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggccuaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaagguaucaaaagaggagaaacggaucaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugccuucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaaaaccaaaccuagacauaauugggaaaagaauagaaaaaauaaagcaagagcaugaaacaucauggcacuacgaccaagaccacccauacaaaacgugggcauaccauggcagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuaggaaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagagaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagggaagaggaagaagcaggaguccugugguaa

SEQ ID NO: 6872 - RNA, 9876 nt, Artificial Sequence
  derived and/or modified CDS sequence (wt) from DENV-2__EU660414__SS-prME
ucugcaggcaugaucauuaugcugauuccaacagugauggcguuccaucuaaccacacgcaacggagaaccacacaugaucgucgguauacaggagaaagggaaaagucuuuuguucaaaacagaggauggugugaacaugugcacccucauggcuauggaccuuggugaauugugugaagacacgaucacguacaaguguccucuucucaggcagaaugagccagaagacauagacugcuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggguccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguuuaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggggacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagcuuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugccauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccauuagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaauagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaucaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaauuacagaaauggguaggcuuccaacauucaugacucagaagacaagagacgcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagacccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaguccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaacccuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuuacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaacaccaaacuuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaagagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacgcuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugccuuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaaguagcaauaaaucagguuagaucucuuauaggcaaugaggaauacacagauuacaugccauccaugaaaagauucagaagagaagaggaagaagcaggaguccugugguaa

SEQ ID NO: 6873 - RNA, 9876 nt, Artificial Sequence
  derived and/or modified CDS sequence (wt) from DENV-2__EU660415__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccgggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccccacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagggccgggacaacugaagcucaacugguucaagaaaggaaguucuaucggucaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugucccaacacaaauagagcuuggaacucguuggagguugaagacuacggcuuuggaguguucaccaccaauauauggcuaaaauugaaagaaaaacaggaugcauucugcgacucaaaacucaugucggcugccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagacuaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacuuauaacagaauggugcugccgaucuugcacauuaccaccccuaagauacagaggugaggaugggugcugguacgggauggaaaucagaccauugaaagagaaggaagaaaaucugguuaacuccuuggucacagccggacaugggcagguagacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuucuccacugcuuuugacauccucacagcaaaaaacggauuggauaccauuagcauugacaaucaagggucucaauccaacagccauuuuucuaacaacccucucaagaacuaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuagagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuauggcaaugguguugucacaaggaguggagcauaugugagugcuauagcccaaacugaaaaaggcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcauacugggcgggaaauuguggaucuaaugugucaugccacauuuaccaugaggcugcuaucaccaguuagagugccaaacuauaauuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacucaguaggaagaccuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugagccagagcgugaaaaaguggaugccauugauggcgaauaccgguugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaauuacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcgggaggggcauagggaagaugacccugggaaugugcugcauaaucacggcuagcauucuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggauuuuggauuaggaagcauugcaacccagcaacccgagagcaacauccuggacauagaccuacgucccgcaucagcuuggacguuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuauucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguuaaucaacagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaacccugggacguccuccccacggugacacagauggcaaugacagacacgacuccauuuggacaacagcguguuuuuaaagaaaaaguggacacgagaacccaagaaccgaaagaaggcacgaagaaacugaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcuggucgacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaccacugguucucuagagagaacucccugagcggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucgugugcuuguuguuccauguagaaaccaagaugaacugauuggcagagcccgaaucucccaaggagcaggguggucuuugcgggagacagccuguuuggggaagucuuacgcucaaauguggagcuugauguauuuccacaggcgugaccucaggcuggcggcaaaugucauuugcucggcagugccaucacacuggguuccaacaagucgaacaaccugguccauacacgccaaacaugaauggaugacaacggaagacauguugacagucuggaacaggguguggauucgagaaaacccauggauggaagauaaaaccccaguggaaucaugggaggaaaucccauacuugggaaaaagagaagaccaauggugcggcucauugaucggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6874 - RNA, 9876 nt, Artificial Sequence
  derived and/or modified CDS sequence (wt) from DENV-2__EU687249__SS-prME
ucugcaggcaugaucauuaugcugauuccaacagugauggcguuucaucuaaccacacgcaacggagaaccacacaugaucgucgguauacaggagaaagggaaaagucuucuguucaaaacagaggauggugugaacauguguacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaaccuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggacaagagguucgucugcaaacacuccaugguagacagaggauggggaaauggauguggauuauuuggaaaggggggcauugugaccugugcuauguucacaugcaagaagaacauggaagggaaaaucgugcaaccagaaaacuuggaauacaccauugugguaacaccucacucaggggaagagcaugcggucggaaaugacacaggaaaacacggcaaggaaaucaaaguaacaccacaaaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaggagucaaauuggauacagaaagaaacauugguuacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauauaucuuaggccgucugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucucugggaggaguguuuacaucuauaggaaaagcucuccaccaagucuuuggagcaaucuauggagcugccuucagugggguuucauggaccaugaaaauucucauaggagucauuaucacauggauaggaaugaacucacgcagcaccucacugucugugucacugguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagccauccagaaagcucgagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaacugaaagaaaaacaggacgcauucugcgacucaaaacucaugucggcggccauaaaagacaacagagccguucaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuacagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuuaugacauugaucacagggaacauguccuucaaagaccuaggaagaguggugguuaugguaggcgcuaccauggcggaugacauagguaugggcgugacuuaucuugcccuacuagcagcuuuuaaaguuagaccaacuuuugcagcuggacuacucuugagaaagcugaccuccaaggaauugaugaugaccaccauaggaauuguacuccucucccaaagcacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcaguggugucaguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccagcucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaagaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucacagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaaguuagaaggggaauggaaggaaggagaagaaguccaagugcuggcacuggagccuggaaaaaauccaagagccguccaaacaaaaccuggucuuuucaaaaccaacaccggaacaauaggugccguaucucuggacuuuuccccuggaacgucaggaucuccaauuaucgacaaaaaaggaaaaguugugggucuuuaugguaaugguguagucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaauccuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugaucaucauggacgaagcccauuucacagacccagcaagcauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagaccguuugguucguuccaagcauaaaagcaggaaaugauauagcagccugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacucacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacaucaacacaccagaaggaaucauuccuaguauguuugaaccagagcgugaaaaaguggaugccauugauggcgaauaccguuugagaggagaagcaaggaaaaccuuuguggacuuaaugaggagaggagauuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcaggugggagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaaccugagagcaacauccuggacauagaucuacgucccgcaucagcuuggacgcuguaugccguggcuacaacauucguuacaccaauguugagacauagcauugagaauuccucagugaauguaucccuaacagcuauagccaaccaagcaacaguguuaaugggucuagggaaaggauggccauugucaaagauggacaucggaguuccccuucuagccauuggauguuacucacaagucaaucccauaacucucacagcagcucuucucuuauugguagcgcauuaugccauuauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggagaguaguggaccucgguuguggcagaggagguuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauugcugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagcccuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccguaacauuggaauugaaagugaaguaccaaaccuagacauaauugggaaaagaauagaaaaaauaaagcaagagcaugaaacaucauggcacuacgaccaagaccacccauacaaaacgugggcauaccauggcagcuaugaaacaaaacagacuggaucagcaucauccauggucaacggaguggucaggcugcugacaaaaccuugggacguccuucccacggugacacagauggcaaugacagacacgacuccauuuggacaacagcguguuuucaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaacgcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacagugauggacaucauaucgagaagagaccaaagagguagugggcaaguugguaccuauggacucaauacuuucaccaauauggaagcccaauuaaucagacagauggagggagaaggaguuuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggagcgauuggacacaagugcccuucuguucacaccauuuccaugagcuaaucaugaaggauggucguguacuuguuguuccauguaggaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacgaccugguccauacacgccaaacaugaauggaugacaacggaagacaugcugacagucuggaacaggguguggauucgagaaaacccauggauggaagacaaaaccccaguggaaucaugggaggaaaucccauaccugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6875 - RNA, 9876 nt, Artificial Sequence
  derived and/or modified CDS sequence (wt) from DENV-2__EU660416__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagauauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagucuugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaagaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaagggaaguucuaucggccaaauguuugagacaacgaugagaggggcgaagagaauggccauuuugggugacacagccugggacuuuggaucccuaggaggaguguuuacgucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucgaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaggcaaaaaugcucuccacagagucuuacaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguucaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuucgauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaaugaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccucaaaauaguaagaaacauggaaaaguaucaauuagcagugaccaucaugacuaucuugugcgucccaaacgcagugauauuacaaaaugcauggaaagugaguugcacaauacuggcagugguguccguuuccccacugcuuuugacauccucacggcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugaguauuuuagccaguucccuccuaaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggagguuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgauaaaaaaggaaaaguugugggucuuuaugguaaugguguugucacaaggaguggagcauaugugagugcuauagcccaaacugaaaaaagcauugaagacaaccccgaaaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucguggucacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcucacuggaaagaagccaaaaugcuccuagauaauauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaauuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucuaacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacgccccaagacaaccaauugaccuacguugucauagccauccucacagugguggccgcaaccauggcaaacgagauggguuuccuagaaaaaacgaagaaggaucuuggauugggaagcauugcaacccagcaacccgagagcaacauccuggacauagacuuacgcccugcaucagcuuggacgcuguaugcuguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucuaacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuucagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaagggcuaacaaaaggaggaccaggacacgaagaacccaucccuaugucaacauauggguggaaccuggugcgucuucagaguggaguugacgucuucuucaucccgccagaaaagugugacacauuguugugugacauaggggagucaucgccaaaucccacaguggaagcaggacgaacacucagaguccuuaauuuaguggaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugauaaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcucggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguuggcaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaagguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6876 - RNA, 9876 nt, Artificial Sequence
  derived and/or modified CDS sequence (wt) from DENV-2__EU660417__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagauauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagucuugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaagaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacgucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucgaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaggcaaaaaugcucuccacagagucuuacaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguucaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuucgauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccucaaaauaguaagaaacauggaaaaguaucaauuagcagugaccaucaugacuaucuugugcgucccaaacgcagugauauuacaaaaugcauggaaagugaguugcacaauacuggcagugguguccguuuccccacugcuuuugacauccucacggcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugaguauuuuagccaguucccuccuaaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggagguuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgauaaaaaaggaaaaguugugggucuuuaugguaaugguguugucacaaggaguggagcauaugugagugcuauagcccaaacugaaaaaagcauugaagacaaccccgaaaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccggcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucguggucacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcucacuggaaagaagccaaaaugcuccuagauaauauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaauuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacgccccaagacaaccaauugaccuacguugucauagccauccucacagugguggccgcaaccauggcaaacgagauggguuuccuagaaaaaacgaagaaggaucuuggauugggaagcauugcaacccagcaacccgagagcaacauccuggacauagacuuacgcccugcaucagcuuggacgcuguaugcuguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucuaacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaguccaggaagguucuggaacacuaccauugcggugucaauggcuaacaucuucagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaagggcuaacaaaaggaggaccaggacacgaagaacccaucccuaugucaacauauggguggaaccuggugcgucuucagaguggaguugacgucuucuucaucccgccagaaaagugugacacauuguugugugacauaggggagucaucgccaaaucccacaguggaagcaggacgaacacucagaguccuuaauuuaguggaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugauaaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcuguugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcucggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguuggcaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaagguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6877 - RNA, 9876 nt, Artificial Sequence
  derived and/or modified CDS sequence (wt) from DENV-2__EU677137__SS-prME
ucugcaggcaugaucauuaugcugauuccaacagugauggcguuccaucuaaccacacgcaacggagaaccacacaugaucgucgguauacaggagaaagggaaaagucuucuguucaaaacagaagauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuucguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaggggaaaaucgugcaaccagaaaacuuggaauacacuauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgauauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcuggaccauggcaccuagguaagcuugagauggacuuugauuucugcgauggaaccacagugacagugacugaggacugcggaaguagaggacccucuuugagaacaacuacugccucuggaaaacucauaacagaauggugcugccgaucuugcacauuaccaccccuaagauacagaggugaggaugggugcugguacgggauggaaauuagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacagucaagggucucaauccaacagccauuuuucuaacaacccucucaagaaccaacaagaaaagaagcuggccacuaaaugaggcuaucauggcagucggaauggugagcauuuuagccaguucccuccuaaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagauggcagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucaccuccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacaaaaaaggaaaaguugugggucuuuacgguaaugguguugucacaaggaguggagcauaugugagugcuauagcccaaacggaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugagacugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguucgaaccagagcgugaaaaaguggaugccauugauggcgaauaccguuugagaggagaagcaaggaaaacauuuguagacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucagacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccuggguaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaaaaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaaccggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcaaugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagagugguuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguga

SEQ ID NO: 6878 - RNA, 9876 nt, Artificial Sequence
  derived and/or modified CDS sequence (wt) from DENV-2__EU677138__SS-prME
ucugcaggcaugaucauuaugcugauuccaacagugauggcguuucaucuaaccacacgcaacggagaaccacacaugaucgucgguauacaggagaaagggaaaagucuuuuguucaaaacagaggauggugugaacaugugcacccucauggcuauggaccuuggugaauugugugaagacacgaucacguacaaguguccucuucucaggcagaaugagccagaagacauagacugcuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguuugucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaaaaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguuuaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggggacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacuuauaacagaauggugcugccgaucuugcacauuaccaccccuaagauacagaggugaggaugggugcugguacgggauggaaaucagaccauugaaagagaaagaagaaaaucugguuaauuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggccgagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaagggcugaacuggaagauggagcuuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugccauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccauuagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagaguaaugcaccaaucauagaugaagaaagagaaaucccugaacguucauggaauucuggacaugagugggucacggauuucaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaauuacagaaauggguaggcucccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguuguuauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucuuuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaacccuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuuacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaacaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaagagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggggaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagccacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugccuuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaaguagcaauaaaucagguuagaucucuuauaggcaaugaggaauacacagauuacaugccauccaugaaaagauucagaagagaagaggaagaagcaggaguccugugguaa

SEQ ID NO: 6879 - RNA, 9876 nt, Artificial Sequence
  derived and/or modified CDS sequence (wt) from DENV-2__EU677149__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagauauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagucuugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaagaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaagggaaguucuaucggccaaauguuugagacaacgaugagaggggcgaagagaauggccauuuugggugacacagccugggacuuuggaucccuaggaggaguguuuacgucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucgaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaggcaaaaaugcucuccacagagucuuacaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguucaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuucgauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccucaaaauaguaagaaacauggaaaaguaucaauuagcagugaccaucaugacuaucuugugcgucccaaacgcagugauauuacaaaaugcauggaaagugaguugcacaauacuggcagugguguccguuuccccacugcuuuugacauccucacggcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugaguauuuuagccaguucccuccuaaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggagguuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgauaaaaaaggaaaaguugugggucuuuaugguaaugguguugucacaaggaguggagcauaugugagugcuauagcccaaacugaaaaaagcauugaagacaaccccgaaaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccauaagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcucacuggaaagaagccaaaaugcuccuagauaauauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaauuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucuaacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacgccccaagacaaccaauugaccuacguugucauagccauccucacagugguggccgcaaccauggcaaacgagauggguuuccuagaaaaaacgaagaaggaucuuggauugggaagcauugcaacccagcaacccgagagcaacauccuggacauagacuuacgcccugcaucagcuuggacgcuguaugcuguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucuaacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugauuuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuucagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaagggcuaacaaaaggaggaccaggacacgaagaacccaucccuaugucaacauauggguggaaccuggugcgucuucagaguggaguugacgucuucuucaucccgccagaaaagugugacacauuguugugugacauaggggagucaucgccaaaucccacaguggaagcaggacgaacacucagaguccuuaauuuaguggaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugauaaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcucggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguuggcaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaagguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6880 - RNA, 9876 nt, Artificial Sequence
  derived and/or modified CDS sequence (wt) from DENV-2__FJ024452__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggaggacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacaacacauuuccagagagucuugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucaucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguacuugggagucauggugcaggccgauagugguugcguugugagcuggaaaaacaaagaacugaaauguggcagugggauuuucaucacagacaacgugcacacauggacagaacaauacaaguuccaaccagaauccccuucgaaauuagcuucagcuauccagaaagcucaagaagagggaauuugugggauccgcucgguaacgagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuucgauuucugcgauggaacuacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauuguuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacuggaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuauuauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaucaaugauugggauuucgugguuacaacugacauuucagaaaugggugccaacuucaaagcugagaggguuauagaccccagacgcugcaugaaaccagucauacuaacagauggugaggagcgggugauucuggcaggaccuaugccaguaacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaauauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcguuaaaagaguucaaagaauuugcagccggaagaaagucucugacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaggaucuuggauuaggaagcauugcaacccagcaacccgagagcaacauccuggacauagaccuacgcccugcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaucaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaccuggugcgucuucagaguggaguugacgucuucuucaucccgccagaaaagugugacacauuguugugugacauaggggagucaucgccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaaguggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugauugacaaggaaaggaaucuccaucuugaaggaaagugugagacaugcguguacaacaugaugggaaaaagagaaaagaagcuaggggaauucggcaaggcaaaaggcagcagagccauaugguacauguggcuuggagcccgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauugcguugugaaaccuuuagaugacagguucgcaaacgcuuugacagcccuaaaugacaugggaaagguuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauugccagagcccgaaucucccaaggagcaggguggucuuugcgagagacggccuguuuggggaagucuuacgcucaaauguggagcuugauguauuuccacaggcgugaucucaggcuggcggcaaaugccauuugcucggcagugccaucacacuggguuccaacaagucgaacaaccugguccauacacgccaaacaugaauggaugacaacggaagacauguugacagucuggaacagaguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6881 - RNA, 9876 nt, Artificial Sequence
  derived and/or modified CDS sequence (wt) from DENV-2__FJ205877__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuccucaggcagaaugagccagaagauauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagucuugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaagaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaagggaaguucuaucggccaaauguuugagacaacgaugagaggggcgaagagaauggccauuuugggugacacagccugggacuuuggaucccuaggaggaguguuuacgucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucgaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaggcaaaaaugcucuccacagagucuuacaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguucaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuucgauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccucaaaauaguaagaaacauggaaaaguaucaauuagcagugaccaucaugacuaucuugugcgucccaaacgcagugauauuacaaaaugcauggaaagugaguugcacaauacuggcagugguguccguuuccccacugcuuuugacauccucacggcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugaguauuuuagccaguucccuccuaaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggagguuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgauaaaaaaggaaaaguugugggucuuuaugguaaugguguugucacaaggaguggagcauaugugagugcuauagcccaaacugaaaaaagcauugaagacaaccccgaaaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccauaagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucguggucacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcucacuggaaagaagccaaaaugcuccuagauaauauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaauuauccagacagaaggugguguuuugauggaauuaagaacaaccaaauccuggaagaaaauguggaaguugaaaucuggccaaaagaaggggaaaggaagaaauugaaacccagaugguuggauccuaggaucuacucugagccccgggcgcuaaaagaguucaaagaauuuccacccggaagaaagucucuaacccugaaccuaaucacagaaauggguaggcuuccaacauucaugacucagaagacaagagacgcacuggacaaccuagcagggcugcacacagcugaagcagguggaagggcggacaaucaugcucucagugaacuggcggagacccuagagacacugcuuuuacugacacuucuggcuacaggcacaggagggaucuuuuuauucuugaugagcgggaggggcauagggaagaugacccugggaaugugcugcauaaucacggcuagcauccuucuaugggacgcacaaauacagccacacuggauagcagcuucaauaauacuggaguuuuuucucauaguuuugcuuauuccagaaccagaaaaacagagaacgccccaagacaaccaauugaccuacguugucauagccauccucacaguggugggcgcaaccaugccaaacgagauggguuuccuagaaaaaacgaagaaggaucuuggauugggaagcauugcaacccagcaacccgagagcaacauccuggacauagacuuacgcccugcaucagcuuggacgcuguaugcuguggcuacaacauuuguuacaccaaugcugagacauagcauugagaauuccucagugaauguaucccuaacagcuauagccaaccaagcgacaguguuaaugggucuagggaaaggaugggcauuggcaaagauggacaucggaguuccccuucucggcauuggauguuacucacaagucaaucccauaacucuaacaggagcucuccucuuauugggagggcauuaugccaucauagggccaggacuucaagcaaaagcaaccagagaagcccagaaaagagcagcgccgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuucagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguugugccagaggaggcuggucauacuauuguggaggacuaaaaaacguaagagaagugaaagggcuaacaaaaggaggaccaggccacgaagaacccaucccuaugucaacauauggguggaaccuggugcgucuucagaguggaguugacgucuucuucaucccgccagaaaagugugacacauuguugugugacauaggggagucaucgccaaaucccacaguggaagcaggacgaacacucagaguccuuaauuuaguggaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugauaaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagacccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaagccagcagagccauaugguacauguggcucggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugccaccuauggacucaauacuuucaccaauauggaagcccaauuaaucagacagauggagggagaaggagucuuuaaaaacauccagcaccugacagucacagaagaaguugccgugcaaaacugguuggcaagagugggccgcgaaagguugccaagaauggccaucaguggagaugauuguguugugaaaccuuuagaugccagguucgcaaacgcuuugacagcccuaaaugccaugggaaagauuagaaaagauauacaacagugggaaccuucaaaaggauggaacgauuggacacaagugcccuucuguucacaccauuuccaugagcuaaucaugaaggauggccguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaagguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6882 - RNA, 9876 nt, Artificial Sequence
  derived and/or modified CDS sequence (wt) from DENV-2__FJ024454__SS-prME
ucugcaggcaugaucauuaugcugauuccaacagugauggcguuccaucuaaccacacgcaacggagaaccacacaugaucgucgguauacaggagaaagggaaaagucuuuuguucaaaacagaggauggugugaacaugugcacucucauggcuauggaccuuggugaauugugugaagacacgaucacguacaaguguccucuucucaggcagaaugagccagaagacauagacugcuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguuugucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccaucacagaagcagaauugaccgguuauggccccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccucaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugauuacagucaacccaauuguaacagaaaaagacagcccagucaacauagaagcagaaccuccauucggagacagcuacaucaucauaggaguagagccgggacaacugaagcucaacugguuuaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggggacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaaccacugccucuggaaaacuuauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuagaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggccgagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagcuuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugccauagcccaaacugaaaaaagcauugaaaacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccauuagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagaguaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggccaaaagaaggggaaaggaagaaauugaaacccagaugguuggaugcuaggaucuacucugacccacuggcgcuaaaagaguucaaagaauuugcagccggaagaaagucucugacccugaaccuaauuacagaaauggguaggcuuccaacguucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaauguuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaacccuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuuacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaacaccaaacuuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaccggaguggucaggcugcugacaaaaccuugggacguccuccccacggugacacagauggcaaugacagacacgacuccauuuggacaacagcguguuuuuaaagaaaaaguggacacgagaacccaagacccgaaagaagccacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaagagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugccagucacagaagaaguugccgugcaaaacugguuggcaagaguggggcgcgaaagguugucaagaaugcccaucaguggagaugauuguguugugaaaccuuuagaugccagguucccaaccgcuuugacaccccuaaaugacaugggaaagauuagaaaagauauccaccagugggacccuucaaaaggauggaacgauuggacacaagucccuuucuguucccaccauuuccaugagcuaaucaugaaggauggucguguacuuguuguuccauguagaaaccaagaugaccugauugccagagcccgaaucucccaaggaccaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaaguagcaauaaaucagguuagaucucuuauaggcaaugaggaauacacagauuacaugccauccaugaaaagauucagaagagaagaggaagaagcaggaguccugugguaa

SEQ ID NO: 6883 - RNA, 9876 nt, Artificial Sequence
  derived and/or modified CDS sequence (wt) from DENV-2__FJ205878__SS-prME
ucugcaggcaugaucauuauguugauuccaacagugacggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaauuacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauucugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcacugucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucuguaucauuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaucaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaaugacggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcaguuggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacagagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacuaaccaucauggaccuccacccaggagcaggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggauuuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagagaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcauuaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaauacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaacugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccauggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagagaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugaaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgagagacggccuguuuggggaagucuuacgcucaaauguggagcuugauguauuuccacaggcgugaucucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucacugauuggguuaacaagcagggccacaugggcaaagaacauccaagcagcaauaaaucagguuagaucucuuauaggcaaugaggaauacacagacuacaugccauccaugaaaagauucagaagagaagaggaagaagcaggaguccugugguaa

SEQ ID NO: 6884 - RNA, 9876 nt, Artificial Sequence
  derived and/or modified CDS sequence (wt) from DENV-2__FJ205879__SS-prME
ucugcagguaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucuaugacaaugcguugcauaggaauaucaaauagagacuuuguagaagggguuucaggaggaaguuggguugacauagucuuagaacauggaagcugugugacgacgauggcaaaaaauaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucaucugcaaacacuccaugguagacagaggauggggaaauggauguggacuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggcuaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuucgagauaauggauuuggaaaaaagauacgucuuaggccgccugaucacagucaacccaauuguaacagaaaaagacagcccagucaacauagaagcagaaccuccauucggagacaguuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaguacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugaccauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggacgcauucugcgacucaaaacucaugucggcggccauaaaagacaacagagccguccaugccgacauggguuacuggauagaaagugcacucaaugacacauggaagauagagaaagccucauucauugagguaaaaaacugccacuggccaaaaucacacacccucuggaguaacggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaauauggaaaaguaucaauuagcagugaccaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuauagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggagggggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuagacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauucccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuagcauguuugaaccagagcgugaaaagguggaugccauugauggcgaauaccguuugagaggagaagcaaggaaaacauuuguggacuugaugaggagaggagacuuaccaguuugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaaugggcaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggauuuuuuuauucuugaugagcgggaggggcauagggaagaugacccugggaaugugcugcauaaccacggcuagcauccuucuaugguacgcacaaauacagccacacuggauagcagccucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacguccugcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacccaagaaggggaacuggcaacaugggagagacgcuuggagagaaauggaaaagccgauugaacgcacugggaaaaagugaauuccagaucuacaagagaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacgugagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauacaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaacagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucugcucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuuguucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6885 - RNA, 9876 nt, Artificial Sequence
  derived and/or modified CDS sequence (wt) from DENV-2__FJ390385__SS-prME
ucugcaggcaugaucauuaugcugauuccaacagugauggcguuccaucuaaccacacgcaacggagaaccacacaugaucgucgguauacaggagaaagggaaaagccuucuguucaaaacagaggauggugugaacaugugcacccucauggccauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagccgauaaacaagagucaaauuggauacagaaagaaacauuggucacuuuuaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauugcaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaggagggaauuugugggauucgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucauucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaaguggguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagaucugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauaucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauucccaguauguuugaaccagagcgugaaaagguggaugccauugauggcgaauaccguuugagaggagaagcaaggaaaacauuuguggacuuaaugaggagaggagacuuaccagucuggcuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacagugcuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcagcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagagaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaacugaaagugaaauaccaaaccuagacauaauuggaaaaagaauagaaaaaauaaagcaagagcaugaaacaucauggcacuacgaccaagaccacccauacaaaacgugggcauaccaugguaguuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucucugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacaugaaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6886 - RNA, 9876 nt, Artificial Sequence
  derived and/or modified CDS sequence (wt) from DENV-2__FJ024458__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccgggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccccacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggucucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggucaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaagacgaucuuugcggccucagcccacugagcuaaaguauucauggaaaacaugggguaaagcaaaaaugcucuccacagagucuuauaaccaaaccuuucucauugauggccccgagacggcagagugucccaacacaaauagagcuuggaacucguuggagguugaagacuacggcuuuggaguguucaccaccaauauauggcuaaaauugaaagaaaaacaggaugcauucugcgacucaaaacucaugucggcugccauaaaagacaacagagccguccaugccgacauggauuacuggauagaaagugcacucaaugacacauggaagauagagaaagccucuuucauugagguaaaaaacugccacugggcaaaaucacacacccucuggaguaauggagugcuagaaagugagaugauaaucccaaagaaucucgcuggaccagugucucaacacaacuauagacuaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacuuauaacagaauggugcugccgaucuugcacauuaccaccccuaagauacagaggugaggaugggugcugguacgggauggaaaucagaccauugaaagagaaggaagaaaaucugguuaacuccuuggucacagccggacaugggcagguagacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuucuccacugcuuuugacauccucacagcaaaaaacggauuggauaccauuagcauugacaaucaagggucucaauccaacagccauuuuucuaacaacccucucaagaacuaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagacggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuagagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuauggcaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaauuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacucaguaggaagaccuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugagccagagcgugaaaaaguggaugccauugauggcgaauaccgguugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaauuacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcgggaggggcauagggaagaugacccugggaaugugcugcauaaucacggcuagcauucuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggauuuuggauuaggaagcauugcaacccagcaacccgagagcaacauccuggacauagaccuacgucccgcaucagcuuggacguuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuauucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguuaaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaacccugggacguccuccccacggugacacagauggcaaugacagacacgacuccauuuggacaacagcguguuuuuaaagaaaaaguggacacgagaacccaagaaccgaaagaaggcacgaagaaacugaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcuggucgacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaccacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucgugugcuuguuguuccauguagaaaccaagaugaacugauuggcagagcccgaaucucccaaggagcaggguggucuuugcgggagacagccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagauaaaaccccaguggaaucaugggaggaaaucccauacuugggaaaaagagaagaccaauggugcggcucauugaucggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6887 - RNA, 9876 nt, Artificial Sequence
  derived and/or modified CDS sequence (wt) from DENV-2__FJ205880__SS-prME
ucugcaggcaugaucauuaugcugauuccaacagugauggcguuccaucuaaccacacgcaacggagaaccacacaugaucguugguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccugcaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacauguaagaagaacauggaagggaaaaucgugcaaccagaaaauuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccaugcaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaaguuuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaguacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugaguuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauccugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauuccuuggucacagccggacaugggcagguugacaauuuuucacugggagucuugggaauggcauuguuccuggaggaaaugcuuaagacccgaguaggaacgaaacaugcaauacuacuaguugcaguuucuuuugugacauugaucacagggaacauguccuucaaagaccuaggaagaguggugguuaugguaggcgccacaauggcggaugacauagguaugggcgugaccuaucucgcccuacuagcagccuuuaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccaggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuaccuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccuuggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggccauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcggugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguccugugguaa

SEQ ID NO: 6888 - RNA, 9876 nt, Artificial Sequence
  derived and/or modified CDS sequence (wt) from DENV-2__FJ390387__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaaucuuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacuuuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggacuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagauggugcugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaagucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguucacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucauuaguacuggugggaauugugacacuguauuugggagucauggugcaggcugauagugguuguguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaucaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaaugacggaugacauagguaugggcgugacuuaucuugccuuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccauccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacuuuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaaggaaagacuguuugguucguuccaagcauaaaagcaggaaaugauauagcagcuugccugagaaaaaauggaaagaaagugauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcauuaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagccauagccaaccaagcgacaguguuaaugggucuggggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcagcugggacaaguaaugcuacuaauccucugcgugacucaaguauugaugaugaggacuacaugggcucugugugaggccuuaaccuuagcuacagggcccaucuccacauugugggaaggaaauccaggaagguucuggaacacuaccauugcggugucaauggcuaacaucuuuagagggaguuacuuggcuggagcuggacuucucuuuuccauuaugaagaacacaaccaauacaagaaggggaacuggcaacaugggagagacgcuuggagagaaauggaaaagccgauugaacgcacugggaaaaagugaauuucagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauugcggaggacuaaaaaacguaagagaagugaaaggccuaacaaaaggaggaccaggacacgaagaaccuaucccuaugucaacauauggauggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcuguugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagagaagaaguuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgcgugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugaaaaacuggcuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugguuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaagagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6889 - RNA, 9876 nt, Artificial Sequence
  derived and/or modified CDS sequence (wt) from DENV-2__FJ024461__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccgggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggacaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccccacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacuuacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggucaaauguuugagacaacgaugagaggggcgaagagaauggccauuuugggugacacagccugggacuuuggaucucuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugaccauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugucccaacacaaauagagcuuggaacucguuggagguugaagacuacggcuuuggaguguucaccaccaauauauggcuaaaauugaaagaaaaacaggaugcauucugcgacucaaaacucaugucggcugccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagacuaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacuuauaacagaauggugcugccgaucuugcacauuaccaccccuaagauacagaggugaggaugggugcugguacgggauggaaaucagaccauugaaagagaaggaagaaaaucugguuaacuccuuggucacagccggacaugggcagguagacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuucuccacugcuuuugacauccucacagcaaaaaacggauuggauaccauuagcauugacaaucaagggucucaauccaacagccauuuuucuaacaacccucucaagaacuaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuagagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuauggcaaugguguugucacaaggaguggagcauaugugagugcuauagcccaaacugaaaaaggcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcauacugggcgggaaauuguggaucuaaugugucaugccacauuuaccaugaggcugcuaucaccaguuagagugccaaacuauaauuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacucaguaggaagaccuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugagccagagcgugaaaaaguggaugccauugauggcgaauaccgguugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaauuacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcgggaggggcauagggaagaugacccugggaaugugcugcauaaucacggcuagcauucuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggauuuuggauuaggaagcauugcaacccagcaacccgagagcaacauccuggacauagaccuacgucccgcaucagcuuggacguuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuauucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguuaaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacuucauggcacuacgaccaagaccacccauacaaaacgugggcauaccaugguagcuaugaaacaaaacagacuggaucagcaucauccauggucaacggaguggucaggcugcugacaaaacccugggacguccuccccacggugacacagauggcaaugacagacacgacuccauuuggacaacagcguguuuuuaaagaaaaaguggacacgagaacccaagaaccgaaagaaggcacgaagaaacugaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcuggucgacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaccacugguucucuagagagaacucccugagcggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacagugauggacaucauaucgagaagagaccaaagagguagugggcaaguugguaccuauggacucaauacuuucaccaauauggaagcccaauuaaucagacagauggagggagaaggagucuucaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucgugugcuuguuguuccauguagaaaccaagaugaacugauuggcagagcccgaaucucccaaggagcaggguggucuuugcgggagacagccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagauaaaaccccaguggaaucaugggaggaaaucccauacuugggaaaaagagaagaccaauggugcggcucauugaucggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6890 - RNA, 9876 nt, Artificial Sequence
  derived and/or modified CDS sequence (wt) from DENV-2__FJ373299__SS-prME
ucugcaggcaugaucauuaugcugauuccaacagugauggcguuccaucuaaccacacgcaacggagaaccacacaugaucgucgguauacaggagaaagggaaaagucuuuuguucaaaacagaggauggugugaacaugugcacccucauggcuauggaccuuggugaauugugugaagacacgaucacguacaaguguccucuucucaggcagaaugagccagaagacauagacugcuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguuuaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggggacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacagcagagugccccaacacaaauagagcuuggaacucguuggagguugaagacuacggcuuuggaguguucaccaccaauauauggcuaaaauugaaagaaaaacaggaugcauucugcgacucaagacucaugucggcggccauaaaagacaacagagccguccaugccgacauggguuacuggauagaaagugcacucaaugacacauggaaaauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggcugacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuucccauaucaauaccaaucacggcagcagcaugguaccugugggaagugaagaaacaacgggccggaguauugugggacguuccuucacccccacccaugggaaaggcugaacuggaagauggagcuuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugccauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacacuaaucuuggcccccacuagaguuguggcagcugaaauggaggaagcucucagaggacuuccaauaagauaccaaaccccagccauuagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcuggaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaauuacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaacccuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuuacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugaggaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaacaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaagagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguuguaaaaccuuuagaugacagguucgcaaacgcuuugacagcccuaaaugacaugggaaagauuagaaaagauauacaacagugggaaccuucaaaaggauggaacgauuggacacaagugccuuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaaugguguggcucauugauuggguuaacaagcagggccacaugggcaaagaacauccaaguagcaauaaaucagguuagaucucuuauaggcaaugaggaauacacagauuacaugccauccaugaaaagauucagaagagaagaggaagaagcaggaguccugugguaa

SEQ ID NO: 6891 - RNA, 9876 nt, Artificial Sequence
  derived and/or modified CDS sequence (wt) from DENV-2__FJ410193__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaauaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucaucugcaaacacuccaugguagacagaggauggggaaauggauguggacuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacaguuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaguacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucauucauugagguaaaaaacugccacuggccaaaaucacacacccucuggaguaacggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacggaauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaauauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggagggggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuagacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauucccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuagcauguuugaaccagagcgugaaaagguggaugccauugauggcgaauaccguuugagaggagaagcaaggaaaacauuuguggacuugaugaggagaggagacuuaccaguuugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaaugggcaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaccacggcuagcauccuucuaugguacgcacaaauacagccacacuggauagcagccucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacguccugcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagagaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacgugagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauacaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgcugacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccagcaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucugcucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucucauaggcaaugaggaauacacagauuacaugccauccaugaaaagauucagaagagaagaggaagaagcaggaguccugugguaa

SEQ ID NO: 6892 - RNA, 9876 nt, Artificial Sequence
  derived and/or modified CDS sequence (wt) from DENV-2__FJ410195__SS-prME
ucugcaggcaugauuauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagucuugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucgaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaauauucauggaaaacaugggguaaagcaaaaaugcucuccacagagucuuauaaccaaaccuuucucauugauggccccgagacggcagagugccccaacacaaauagagccuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuucgauuucugcgauggaacuacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaagaaaugcuuaggacccgaguaggaacgaaacaugcaauacuacuaguugcaguuucuuuugugacauugaucacagggaacauguccuucaaagaccuaggaagaguggugguuauaguaggcgccacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucaugacuaucuugugcgucccaaacgcagugauauuacaaaaugcauggaaagugaguugcacaauacuggcagugguguccguuuccccacugcuuuugacauccucacggcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugacauucccaugacaggaccacuaguggcuggaggacuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuucuuccuauaucaauaccaaucacggcagcagcaugguaccugugggaagugaagaaacaacgggccggaguuuugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuauuauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucguggucacaacugacauuucagaaaugggugccaauuucaaagcugagaggguuauagaccccagacgcugcaugaaaccagucauacuaacagauggugaggagcgggugauucuggcaggacccaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaauauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaauuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuauucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacgccccaagacaaccaauugaccuacguugucauagccauccucacagugguggccgcaaccauggcaaacgagauggguuuccuagaaaaaacgaagaaggaucuuggauugggaagcauugcaacccagcaacccgagagcaacauccuggacauagaccuacgcccugcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuucagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaaaugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaccuggugcgucuucagaguggaguugacgucuucuucaucccgccagaaaagugugacacauuguugugugacauaggggagucaucgccaaauccaacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucgaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauuuacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagagggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauucaagcagcaauaaaucagguuagaucucuuauaggcaaugaggaauacacagauuacaugccauccaugaaaagauucagaagagaagaggaagaagcaggaguccugugguaa

SEQ ID NO: 6893 - RNA, 9876 nt, Artificial Sequence
  derived and/or modified CDS sequence (wt) from DENV-2__FJ432726__SS-prME
ucugcaggcaugaucauuaugcugauuccaacaguaauggcguuccaucuaaccacacgcaacggagaaccacacaugaucgucgguauacaggagaaagggaaaagucuucuguucaaaacagaggauggcgugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguucugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagagaacuuggaauacaccauugugguaacaccucacucaggggaggagcaugcggucggaaaugacacaggaaaacacggcauggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuccuagaccugccauuaccauggcugcccggagcggauaaacaagagucaaauuggauacagaaagaaacauugguuacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggaucuggaaaaaagauaugucuuaggccgccuaaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucaucaucacauggauaggaaugaacucacgcagcaccucacuaucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucgguaacaagauuggagaaccuaauguggaaacaaauaacaccagaauuaaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagcgucucaacacaacuauagaccaggcuaccauacacaaauagcgggaccauggcaccuagguaagcuugagauggacuuugauuucugcgauggaaccacagugauagugacugaggacugcggaaauagaggacccucuuugagaacgacuacugccucuggaaaacucauaacagaauggugcugccgaucuugcacauuaccaccccuaagauauagaggugaggauggaugcugguacgggauggaaaucagaccguugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauagguaugggcgugacuuaucuugcccuacuagccgccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccgagagccguccaaacaaaaccuggucuuuuuaaaaccaacaccggaacaauaggugccguaucucuggacuuuuccccuggaacgucaggaucuccaaucaucgacaaaaaagggaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacggggucugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugaucaucauggacgaagcccauuucacagacccagcaaguauagcagcuagaggauacaucucaacccgaguggaaaugggugaggcagcugggauuuucaugacagccacucccccgggaaguagagauccauucccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaggaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagaccuuagagacacugcuuuuacugacacuucuggccacagucacaggagggaucuuuuuauucuugaugagcgggaggggcauagggaagaugacccuggggaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagagaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaacguaucccuaacagcuauagccaaccaagcaacaguguuaaugggucuagggaaaggauggccauugucaaagauggacaucggaguuccccuucucgccauuggauguuacucacaagucaauccuauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaagaaguggauaggaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacgucauggcacuacgaccaagaccacccauacaaaacgugggcauaccacgguagcuaugaaacaaaacagacuggaucagcaucauccauggucaacggaguggucaggcugcugacaaaaccuugggacguccuucccacggugacacagauggcaaugacagacacgacuccauuuggacaacagcguguuuuuaaagaaaaaguggacacgagaacccaagaaccaaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaaaucggcacgugaggcuguugaagauaguagguuuugggagcugguugacaaggaaaggaaucuccaucuugaaggaaagugugaaacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguauacuuguuguuccauguagaaaccaagaugaacugauuggcagagcccgaaucucccaaggagcaggguggucucugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcgaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6894 - RNA, 9876 nt, Artificial Sequence
  derived and/or modified CDS sequence (wt) from DENV-2__JF730049__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaacugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagucuaaaagaagagcaggauaagagguucgucugcaaacacuccaugguagacagaggauggggaaauggauguggauuauuuggaaagggaggcauugugaccugugccauguucacaugcaaaaagaacauggaagggaaaaucgugcaaccagaaaauuuggaauacaccauugugguaacaccucacucaggggaggagcauguggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauugugacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaguacaaguuccaaccagaaucccccucaaaacuagcuucagcuauccagaaagcucaagaagagggaauuugugggauccgcucgguaacaagauuggagaaccuaauguggaaacaaauaacaccagaauugaaucacauucuaacagaaaaugaggugaaguugacuauuaugacaggagacaucaaaggaaucaugcaggcaggaaaacgaucuuugcggccucagcccacugagcuaaaguauucauggaaaacaugggguaaagcaaaaauguucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaggugaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccggucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaagacccgaguaggaacgaaacaugcaauacuacuaguugcaguuucuuuugugacauugaucacagggaacauguccuucaaagaccuaggaagagugguggucaugguaggcgcuacaauggcggaugacauagguaugggcgugacuuaucuugcccuacuagcagccuuuaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuagaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccugaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacauugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccagcaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcucaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauucuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuaccuggcuggagcuggacuucucuuuuccauuaugaagaacacaaccaacacaagaaggggaacugguaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggaaucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucacggauguugaucaauagauucacaaugagacacaagaaagccacuuaugagccggauguugaccucggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaauggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuuaggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggccauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaauugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucugauaggcauugaggaauacacagauuacaugccauccaugaaaagauucagaagagaagaggaagaggcaggaguccugugguaa

SEQ ID NO: 6895 - RNA, 9876 nt, Artificial Sequence
  derived and/or modified CDS sequence (wt) from DENV-2__FJ562098__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacagaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugcgcuauguucacaugcaaaaagaacauggaagggaaaaucgugcaaccagaaaacuuggaauacaccauugugguaacaccucacucaggggaggagcaugcagucggaaaugacacaggaaaacauggcaaggaaaucaaagugacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgcuugaucacagucaacccaauugcaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccauugagcuaaaguauucauggaaaacaugggguaaggcaaaaaugcucuccacagagucucacaaccaaaccuuucucauugauggccccgagacggcagagugccccaacacaaauagagcuuggaacucguuggagguugaagacuacggcuuuggaguguucaccaccaauauauggcuaagauuaaaagaaaaacaggaugcauucugcgacucaaaacucaugucggcggccauaaaagacaacagagcuguccaugccgacauggguuacuggauagaaagugcacucaaugacacauggaagauagagaaagccucuuucauugagguaaaaaacugccacuggccaaaaucacacacccucuggaguaauggagugcuagaaagugagaugguaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggaccuucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuuguaacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugugucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaacccucaugggcggacgucaaaaaagaucuaauaucauauggaggaggcuggaagcuagaaggagaauggaaggaaggagaagaaguccaggugcuggcacuggagccugggaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuacaaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuagcaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauaguauugagaauuccucagugaauguaucccuaacagcuauagccaaccaagcaacaguguuaaugggucuagggaaaggauggccauugucaaagauggacaucggaguuccccuccucgccauuggauguuacucacaagucaaucccauaacucucacagcagcucuccucuuauugguagcgcauuaugccaucauagggccaggacuucaagcaaaagcaaccagagaagcccagaaaagagcagcggcggguaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugaugucuucuucaucccgccagaaaagugugacacauuguugugugacauaggggagucaucaccaaaucccacaguggaagcaggacgaacacucagaguccuuaauuuaguagaaaacugguugaacaacaacacucaauuuugcauaaaaguucucaacccauauaugcccucaguuauagaaaaaauggaagcacugcaaaggaaauauggaggagccuuagugaggaauccacucucacggaacuccacacaugagauguacuggguauccaaugcuucugggaacauagugucaucagugaacaugauuucaaggauguugaucaauagauucacaaugagacacaagaaagccacuuacgagccggauguugaccuuggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaauggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuucaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccugaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaacacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucgcguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccaucuaugaaaagauucagaagagaagaggaagaagcaggaguccugugguaa

SEQ ID NO: 6896 - RNA, 9876 nt, Artificial Sequence
  derived and/or modified CDS sequence (wt) from DENV-2__FJ859028__SS-prME
ucugcaggcaugaucauuaugcugauuccaacagugauggcguuccaucuaaccacacgcaacggagaaccacacaugaucgucgguauacaggagaaagggaaaagucuuuuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguaguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauucaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguuuaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagcgggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaaaacaacagagccguccaugccgacauggguuauuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagagugguggucaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuggaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugccauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccauuagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauuccggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucguggucacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcccacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaauuacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauugggaagcauugcaacccagcaacccgagagcaauauccuggacauagaccuacgucccgcaucagcuuggacgcuguaugccguggcuacaacauuuguuacaccaaugcugagacauagcauugagaauuccucagugaauguaucccuaacagccauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagaaacacuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauauuauuguggaggacuaaaaaacguaagagaagugaaaggccuuacaaaaggaggaccaggacacgaagaacccaucccuaugucaacauauggguggaaucuggugcgucuucagaguggaguugacgucuucuuuaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacuacaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagauauaauugggaaaagaauagaaaaaauaaagcaagagcaugaaacaucauggcacuacgaccaagaccauccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacagugauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugccuuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucacugauuggguuaacaagcagggccacaugggcaaagaacauccaaguagcaauaaaucagguuagaucucuuauaggcaaugaggaauacacagauuacaugccauccaugaaaagauucagaagagaagaggaagaagcaggaguccugugguaa

SEQ ID NO: 6897 - RNA, 9876 nt, Artificial Sequence
  derived and/or modified CDS sequence (wt) from DENV-2__FJ410200__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggguuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucauuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaucaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuuaauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaaugacggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggaggacuccucacugugugcuacgugcucacuggacgaucggccgacuuggaacuggagagagcaaccgaugucaaaugggaagaccaagcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucccuggacuuuuccccuggaacgucaggaucuccaaucaucgacaaaaaaggaaaaguugugggucuuuaugguaaugguguugucacaagaaguggagcauaugugagugcuauagcccaaacugaaaaaagcauugaaaacaaccccgagaucgaagaugacauuuuccgaaagagaagacugaccaucauggaccuccacccaggagcgggaaagacgaaaagauaccuuccagccauagucagagaagccauaaaacgggguuugagaacguuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugacauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcauuaacuaugcagacagaaggugguguuuugauggaauuaagaacaaccaaauccuggaagaaaauauggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacgcuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccggcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccgauaccuuaugauccaaaguuugaaaagcaguugggacaaguaaugcuacuaguccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaauacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacugaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcuccugacaaaaccuugggacguccuucccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaggugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugaaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6898 - RNA, 9876 nt, Artificial Sequence
  derived and/or modified CDS sequence (wt) from DENV-2__FJ410202__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaagcaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggacuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauugugacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuguaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucucugcggccucagccuacugagcuaaaguauucauggaaaacaugggguaaagcaaaaaugcucuccacagagucuuauaaccaaaccuuucucauugauggccccgagacggcagagugucccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucauucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguaugggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaaccuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuagacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaucuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcucauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaggaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuagcauguuugaaccagagcgugaaaagguggaugccauugauggcgaauaccguuugagaggagaagcaaggaaaacguuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaagucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcuacacacggcugaaguagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacaaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuccaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggccaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagagaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguggaaaauugguugaacaauaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacagugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaacgcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacagugggaaccuucaaaaggauggaacgauuggacacaagugcccuucuguucacaccauuuccaugagcuaaucaugaaggauggucgugugcuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcagcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacauagauuacaugccauccaugaaaagauucagaagagaagaggaagaagcaggaguccugugguaa

SEQ ID NO: 6899 - RNA, 9876 nt, Artificial Sequence
  derived and/or modified CDS sequence (wt) from DENV-2__FJ410208__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggccauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucauuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaucaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccacacacaaauagcaggaccauggcaccuagguaagcuugagauggacuuuaauuucugugauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccacugaaagagaaagaagaaaaucugguuaacucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaaugacggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaccuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucccuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacguuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugacauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcauuaacuaugcagacagaaggugguguuuugauggaauuaagaacaaccaaauccuggaagaaaauauggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaauugccggagacccuagagacacugcuuuuacugacgcuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccggcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaguccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaauacaagaaggggaacuggcaauaugauagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccgggacacgaagaacccauccccaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugaaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6900 - RNA, 9876 nt, Artificial Sequence
  derived and/or modified CDS sequence (wt) from DENV-2__FJ461305__SS-prME
ucugcaggcaugaucauuauguugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuuugaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuguuuggaaagggaggcauugugaccugugcuauguucacaugcaaaaagaacauggaagggaaaaucgugcaaccagaaaauuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcaaauggaaaauaaagcuuggcuggugcauaggcaaugguuucuagaccugccauuaccauggcugcccggagcggauaaacaagagucaaauuggauacagaaagagacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguucaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacaguuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugcuuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaguacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucuaguuaacuccuuggucacagccggacaugggcagauugacaauuuuucacugggagucuugggaauggcauuguuccuggaggaaaugcuuaagacccgaguaggaacgaaacaugcaauacuacuaguugcaguuucuuuugugacauugaucacagggaacauguccuucaaagaccuagggagaguggugguuaugguaggcgcuacaauggcggaugacauagguaugggcgugacuuaucuugcccuacuagcagccuuuaaaguuagaccaaccuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccuaucaauaacaauaucagaagaugguagcaugucgauaaaaaaugaagaggaagaacaaacacugaccauacucauuagaacaggauugcugguaaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagcccggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugagaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaaugggcaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacaccaccauugcggugucaauggcuaacaucuuuagagggaguuaccuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacgugagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacacaauuuugcauaaaaguucucaacccauauaugcccucaguuauagaaaaaauggaagcacugcaaaggaaauauggaggagccuuagugaggaauccacucucacggaacuccacacaugagauguacuggguauccaaugcuucugggaacauagugucaucagugaacaugauuucaaggauguugaucaauagauucacaaugagacacaagagagccacuuacgagccggauguugaccucggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaagugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggccauuuucaaacuaacguaucaaaacaagguggugcgugugcaaagaccaacgccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaagcaugaauggaugacaacggaagacauguugacagucuggaacaggguguggauucgagaaaacccauggauggaagacaaaacuccaguggaaucaugggaggaaauuccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguccugugguaa

SEQ ID NO: 6901 - RNA, 9876 nt, Artificial Sequence
  derived and/or modified CDS sequence (wt) from DENV-2__FJ410215__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcagucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguucuagggucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaaugugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauuuuagcggaaaaugaggugaaguugacuauuaugacaggagacaucaaaggaaucaugcaggcaggaaaacgaucuuugcggccucagcccacugagcuaaaguauucauggaaaacaugggguaaagcgaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucaggaaaacucauaacagaauggugcugccgaucuugcacacuaccaccccuaagauacagaggugaagaugggugcugguacgggauggaaaucagaccauugaaagagaaagaagaaaaucugguuaacuccuuggucacagccggacaugggcagguugacaauuuuucacugggagucuugggaauggcauuguucuuggaggaaaugcuuaggacccgaguaggaacgaaacaugcaauacuacuaguugcaguuucuuuugugacacugaucacagggaacauguccuucaaagaccuaggaagaguggugguuaugguaggcgcugcaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuucugacauccucacagcaaaaaacggauuggauaccauuagcauugacaaucaagggucucaauccaacagcuauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggugcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaauuaucgacaaaaaaggaaaaguugugggucuuuaugguaaugguguugucacaaggaguggagcauauguaagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacggggcuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccaggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaucguuugagaggagaagcaaggaaaaccuuuguggacuuaaugaggagaggagacuuaccagucugguuggcuuacaaaguggcagcugaaggcaucaacuaugcagacagaaggugguguuuugaugggauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucuaacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacuccuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaacugaccuacguugucauagccauccucacagugguggccgcaaccauggcaaacgagauggguuuccuagaaaaaacgaagaaggauuuuggauuaggaagcauugcaacccagcaacccgagagcaacauccuggacauagaccuacgucccgcaucagcuuggacgcuguaugccguggcuacaacauucgucacaccaaugcugagacauagcauugagaauuccucagugaauguaucccuaacagcuauagccaaccaagcaacaguguuaaugggucuagggaaaggauggccauugucaaagauggacaucggaguuccccuucucgccaucggauguuacucacaagucaaccccauaacucucacagcagcucuccucuuauugguagcgcauuaugccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggcuuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaccuacaagaaaaguggaauccaggaaguggauagaaccuuagcaaaagaaggcaucaaaagaggagaaacggaccaucacgcugugucgcgaggcucggcaaaacugagaugguucguugagagaaacauggucacaccagaagggaaaguaguggaccucgguugcggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaacugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaaacuaggggaauucggcaaggcaaaaggcagcagagccauaugguacauguggcuuggagcucgcuuccuggaguuugaagcccuaggauuccuaaaugaagaucacugguucucuagagagaacucccuaaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgcgugcaaaggccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugaucggcagagcccgaaucucccaaggagcaggguggucuuugcgggaaacggccuguuuggggaagucuuacgcccaaauguggaguuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaaugguguggcucauugauuggguuaacaagcagggccacaugggcaaagaacauccaagcagcaauaaaucagguuagaucucuuauagguaaugaggaauacacagauuacaugccauccaugaaaagauucagaagagaagaggaagaagcaggaguccugugguaa

SEQ ID NO: 6902 - RNA, 9876 nt, Artificial Sequence
  derived and/or modified CDS sequence (wt) from DENV-2__FJ461309__SS-prME
ucugcaggcaugaucauuauguugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuuugaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuguuuggaaagggaggcauugugaccugugcuauguucacaugcaaaaagaacauggaagggaaaaucgugcaaccagaaaauuuggaauacaccauuguggugacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcaaauggaaaauaaagcuuggcuggugcauaggcaaugguuucuagaccugccauuaccauggcugcccggagcggauaaacaagagucaaauuggauacagaaagagacauuggucacuuucaaaaauccccaugcgaagaaacaggacguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguucaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacaguuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauagggaaagcucuccaccaagucuuuggagcaaucuauggagccgcuuuuagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaguacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacauggggcaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauuuugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaaccacugccucuggaaaacucauaacagaauggugcugccgaucuugcacauuaccaccccuaagauacagaggugaggaugggugcugguacgggauggaaaucagaccauugaaagagaaagaagaaaaucuaguuaacuccuuggucacagccggacaugggcagguugacaauuuuucacugggagucuugggaauggcauuguuccuggaggaaaugcuuaagacccgaguaggaacgaaacaugcaauacuacuaguugcaguuucuuuugugacauugaucacagggaacauguccuuuaaagaccuaggaagaguggugguuaugguaggcgcuacaauggcggaugacauagguaugggcgugacuuaucuugcccuacuagcagccuuuaaaguuagaccaacuuucgcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccuaucaauaacaauaucagaagaugguagcaugucgauaaaaaaugaagaggaagaacaaacacugaccauacucauuagaacaggauugcugguaaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuauggcaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuuuacagauccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaaaaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugagaaugaccaguacauauacaugggagaaccucuggaaaaugaugaagacugugcacacuggaaagaagccaaaaugcucuuagauaacauuaacacaccagaaggaaucauuccuaguauguucgaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuaccuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacgugagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagaugguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucguuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggccauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugccuuucugcucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuucacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaacuccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaagaauacacagauuacaugccauccaugaaaagauucagaagagaagaggaagaggcaggaguccugugguaa

SEQ ID NO: 6903 - RNA, 9876 nt, Artificial Sequence
  derived and/or modified CDS sequence (wt) from DENV-2__FJ461311__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacacgcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuuugaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucauuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaucaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuuaauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaaugacggaugacauagguaugggcgugaccuaucuugcccuacuagcagccuucaaaguuagaccaaccuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggacuggauaccauuagcauugacaaucaagggucucaacccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggaugucaaaaaagaucuaauaucauauggaggaggcuggaagcuagaaggagaauggaaggaaggagaagaaguccaggugcuggcacuggaaccuggaaaaaauccaagagccguccaaacaaaacccggucuuuucaaaaccaacaccggaacaauaggugcuguaucccuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagggaagccauaaaacgggguuugagaacguuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugacauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccaguuauacuaacagauggugaggagcgggugauucuugcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggggaagcaaggaaaacauuuguggacuuaaugaggagaggagacuuaccagucugguuggcuuacaaaguggcagcugaaggcauuaacuaugcagacagaaggugguguuuugauggaauuaagaacaaccaaauccuggaagaaaauauggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacgcuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccggcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaguccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaauacaagaaggggaacuggcaacaugggagagacgcuuggagagaaauggaaaagccaauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcauaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugaaaaacugguuggcaagaguggggcgcgaaagguugucaagaauggcuaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcgguucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6904 - RNA, 9876 nt, Artificial Sequence
  derived and/or modified CDS sequence (wt) from DENV-2__FJ410217__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaauaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcagucggaaaugacacaggaaaacacggcaaggaaaucaaagugacaccacagaguuccaucacagaagcagaauugaccgguuauggcaccgucacgauggagugcuccccgagaacaggccucgacuucaaugagaugguguuguugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguaucugggagucauggugcaggccgauagugguugcauugugagcuggaaaaacaaagaacugaaauguggcagugggauuuucgucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucucacaaccaaaccuuucucauugauggccccgagacggcagagugccccaacacaaauagagcuuggaacucguuggagguugaagacuacggcuuuggaguguucaccaccaauauauggcuaagauugaaagaaaaacaggaugcauucugcgacucaaaacucaugucggcggccauaaaagacaacagagccguccaugccgacauggguuacuggauagaaagugcacucaaugacacauggaagauagagaaagcuucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggaccuucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacugguugcaguuucuuuugugacauugauuacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagcccuaggcaugaugguccuuaaaauaguaagaaacauggaaaaguaucaauuggcagugacuaucauggcuaucuugugugucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaacgauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauuuuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugagaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuacaaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuagcaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuagcagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaacugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagugggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacaaagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucgucacaccaaugcugagacauaguauugagaauuccucagugaauguaucccuaacagcaauagccaaccaagcaacaguguuaaugggucuagggaaaggauggccauugucaaagauggacaucggaguuccccuucuugccauuggauguuauucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaacugucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacgcaagaaggggaacuggcaacaugggagagacgcuuggagagaaguggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaacugguugaacaacaacacucaauuuugcauaaaaguucucaacccauauaugcccucaguuauagaaaaaauggaagcacugcagaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccugaaugaagaucacugguucucuagagagaacucccugagcggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagcgggcaaguugguaccuauggacucaacacuuucaccaauauggaagcccaauuaaucagacagauggagggagaaggagucuuuaaaaacauccagcaccugacggucacagaagaaguugccgugcaaaacugguuggcaagaguggggcgcgaaagguugucaagaauggccaucaguggagaugauuguguugugaaaccuuuagaugacagguuugcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6905 - RNA, 9876 nt, Artificial Sequence
  derived and/or modified CDS sequence (wt) from DENV-2__FJ410219__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccugcaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcgaucuuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacuuuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccugaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaaacucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucauuaguacuggugggaauugugacacuguauuugggagucauggugcaggcugauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgauuuuugcggccucagcccacugagcuaaaguauucauggaaaacaugggguaaagcaaaaaugcucuccacagagucuuauaaucaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguuccuggaggaaaugcuuaggacucgaguaggaaugaaacaugcaauacuacuaguugcaguuucuuuugugacauugaucacagggaacauguccuucaaagaccuaggaagaguggugguuaugguaggcgcuacaaugacggaugacauagguaugggcgugacuuaucuugcccuacuagcagccuucaaaguuagaccaacuuuugcagcugggcuacucuugagaaagcugacuuccaaggaauugaugaugauuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggccgacuuggaacuggagagaguaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggguugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccauccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacuuuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcauuaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaauacaagaaggggaacuggcaacaugggagagacgcuuggagagaaauggaaaagccgauugaacgcacugggaaaaagugaauuucagaucuacaagaaaaguggaauccaggaaguggauagaaccuuagcaaaagaaggcauaaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaaccuaucccuaugucaacauauggauggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaauauagugucaucagugaacaugauuucaaggauguugaucaauagauucacaaugagacacaagaaagccacuuacgagccggauguugaccucggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagagaagaaguuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugaaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6906 - RNA, 9876 nt, Artificial Sequence
  derived and/or modified CDS sequence (wt) from DENV-2__FJ461314__SS-prME
ucugcaggcaugaucauuaugcugauuccaacagugauggcguuccaucuaaccacacgcaacggagaaccacacaugaucgucgguauacaggagaaagggaaaagucuucuguucaaaacagaagauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcugcagcuuaaaggaaugucauacuccaugugcacaggaaaguuuaaaguugugaaggaaauagcagaaacacaacauggaacgauagucaucagagugcaauaugaaggggacggcuccccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucgauaggaaaagcucuccaccaagucuuuggagcaaucuauggagcugccuucagugggguuucauggaccuugaaaauccucauaggagucaucaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuagucgcaguuucuuuugugacauugaucacagggaacauguccuucaaagaccuaggaagaguggugguuaugguaggugcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcagaaaacggauuggauaccauuagcauugacaaucaagggucucaauccaacagccauuuuucuaacaacccucucaagaaccaacaagaaaagaagcuggccacuaaaugaggcuaucauggcagucggaaugguaagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaccuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuucgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugacauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccgucugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcuacacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcagcugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacacacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguuuguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguuaugugacauaggggagucaucaccaaaucccacaguggaagcaggacgaacacucagaguccuuaauuuaguagaaaauugguugaacaacaacacucaauuuugcauaaaaguucucaacccguauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagggccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugaucggcagagcccgaaucucccaaggagcaggguggucuuugcgagagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaucaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6907 - RNA, 9876 nt, Artificial Sequence
  derived and/or modified CDS sequence (wt) from DENV-2__FJ410221__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacugcuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcuguguaacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguacuugggagucauggugcaggccgauagugguugcguugugagcuggaaaaacaaagaacugaaauguggcagugggauuuucaucacagacaaugugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaguggugcugccgaucuugcacacuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguucuuggaggaaaugcuuaggacccgaguaggaacgaaacaugcaauacuacuaguugcaguuucuuuugugacauugaucacagggaacauguccuucaaagaccuaggaagaguggugguuaugguaggcgcuauaauggcggaugacauagguauaggcgugacuuaucuugcccuacuagcagccuucaaaguuagaccaacuuuugcagcuggacuacucuugagaaagcugaccuccaaggaauugaugaugaccaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaacccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcgaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccaccuaugggaaaggcugaacuggaagauggagccuacagaaucaagcaaaaagggauucuuggauacucucagaucggagcuggaguuuacaaagaaggaacauuucauacaauguggcaugucacacguggugcuguucuaaugcacaaaggaaagaggauugaaccuucaugggcggacgucaaaaaagaucuaauaucauauggaggaggcuggaagcuagaaggagaauggaaagaaggagaagaaguccaggugcuggcacuggagccuggaaaaaauccaagagccguccaaacaaaaccuggucuuuucaaaaccaacaccggaacaauaggugccguaucccuggacuuuuccccuggaacgucaggaucuccaauuaucgacaaaaaaggaaaaguugugggucuuuaugguaaugguguugucacaaggaguggagcauaugugagugcuauagcccaaucugaaaaaaguauugaagacaaccccgagaucgaagaugacauuuuccgaaagagaagacugaccaucauggaccuccacccaggagcgggaaagacgaaaagauaccuuccagccauagucagagaagccauaaaacgggguuugagaacacuaaucuuggcccccacaagaguuguggcagcugaaauggaggaagcucucagaggacuuccaauaagauaccaaaccccagccaucagaguugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagauggcuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggccacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuccucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuuuaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaagauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacguuggaauugaaagugaaauaccaaaccuagacauaauugggaaaagaauagaaaaaauaaagcaagagcaugaaacaucauggcacuacgaccaagaccacccauacaaaacaugggcauaccaugguagcuaugaaacaaaacagacuggaucagcaucauccauggucaacggaguggucaggcugcugacaaagccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaggcccuaggauucuuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggcagaggcuauuuucaaacuaacguaucaaaacaagguggugcgugugcaaagaccaacaccaagagguacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaagucgccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagauaaaaccccaguggaaucaugggaggaaaucccauacuugggaaaaagagaagaccaaugguguggcucauugaucggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6908 - RNA, 9876 nt, Artificial Sequence
  derived and/or modified CDS sequence (wt) from DENV-2__FJ547064__SS-prME
ucugcaggcaugaucauuauguugauuccaacagugauggcguuccaucuaacuacacgcaacggagaaccacacauggucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuucguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguuugucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcacugucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucuguaucauuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcgaaaaugcucuccacagagucuuauaaucaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaaugacggaugacauagguaugggcgugacuuaucuugcccuacuagcagccuucaaaguuagaccaacuuuugcagcugggcuacucuugagaaagcugaccuccaaggaauugaugaugacuacuauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacagagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacaucuuccgaaagagaagacuaaccaucauggaccuccacccaggagcaggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagacgaagaaagagaaaucccugaacguucauggaauucuggacaugagugggucacggauuuuaaagggaagacuguuugguucguuccaagcauaaaagcaggaaaugauauaguagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcauuaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaauacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacauucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaacugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccauggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagagaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguuggcaccuauggacucaauacuuucaccaauauggaagcccaauuaaucagacagauggagggagaaggagucuuuaaaaacauccagcaccugacagucacagaagaaguugccgugaaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgagagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagacuacaugccauccaugaaaagauucagaagagaagaggaagaagcaggaguccugugguaa

SEQ ID NO: 6909 - RNA, 9876 nt, Artificial Sequence
  derived and/or modified CDS sequence (wt) from DENV-2__FJ410223__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaucuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuuuauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaagucgugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuauuggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccagccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugagguaaaguugacuaucaugacaggagacaucaaaggaaucaugcaggcaggaaaacgauccuugcggccucagcccacugagcugaaguauucauggagaacaugggguaaagcaaaaaugcucuccacagagucuuauaaccaaaccuuucucauugauggccccgagacggcagagugucccaacacaaauagagcuuggaacucgcuggagguugaagacuacggcuuuggaguguucaccaccaauauauggcuaaaauugaaagaaaaacaggaugcauucugcgacucaaaacucaugucugcggccauaaaagacaacagagccguccaugccgacauggguuacuggauagaaagugcacucaaugacacauggaagauagagaaagccucuuucauugagguaaaaaacugccacuggccgaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacguugaucacagggaacauguccuucaaagaccuaggaagaguggugguuaugguaggcgccacaauggcggaugacauagguaugggcguaacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauuaacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcacugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaagcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacaucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagaaaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaauuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacaucucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacuggcacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauuaguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggccacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucggggaacuuaaaaaaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaacaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacagugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucguuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucaagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaacccuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcugguggcaaaugccauuugcucggcagugccaucacacuggguuccaacaagucgaacaaccugguccauacacgccaaacaugaauggaugacaacggaagacauguugacggucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6910 - RNA, 9876 nt, Artificial Sequence
  derived and/or modified CDS sequence (wt) from DENV-2__FJ410224__SS-prME
ucugcaggcaugaucauuaugcugauuccaacagugauggcguuccaucuaaccacacgcaacggagaaccacacaugaucgucggcauacaggagaaagggaaaagucuucuguucaaaacagaggauggugugaacaugugcacccucauggcuauggaccuuggugaauugugugaagacacagucacguacaaguguccucuucucaggcagaaugagccagaagacauagacuguuggugcaacuccacguccacguggguaaccuaugggaccuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcgcugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguucuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaagcucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacguggauaggaaugaacucacgcagcaccucacugucugugucacuaguacuggugggaacugugacacuguauuugggaguuauggugcaggccgauagugguugcguugugagcuggaaaagcaaagaacugaaauguggcagugggauuuucaucacagacaaugugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauuuuagcagaaaaugaggugaaguugaccauaaugacaggagacauuaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccuccuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcgggaauagaggacccucuuugagaacaacuacugccucaggaaaacucauaacagaauggugcugccgaucuugcacacuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguucuuggaggaaaugcuuaggacccgaguaggaacgaaacaugcaauacuacuaguugcaguuucuuuugugacacugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaacugaugaugacuaccauaggaauuguacuccucucccaaaguaccauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagcuauuuuucuaacaacccucucaagaaccaacaagaaaagaagcuggccgcuaaaugaggcuaucauggcagucggaauggugaguauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagagcaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagccggaguuuacaaagaaggaacauuucauacaauguggcaugucacacguggugcuguucuaaugcacaaaggaaagaggauugaaccuucaugggcggacgucaaaaaagaucuaauaucauauggaggaggcuggaagcuagaaggagaauggaaggaaggagaagaaguccaggugcuggcacuggagccugggaaaaauccaagagccguccaaacaaaaccuggucuuuucaaaaccaacaccggaacaauaggugccguaucucuggacuuuuccccuggaacgucaggaucuccaauuaucgacaaaaaaggaaaaguugugggucuuuaugguaaugguguugucacaaggaguggagcauauguaagugcuauagcccaaacugaaaaaagcauugaagacaaccccgagaucgaagaugacauuuuccgaaagagaagacugaccauuauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugccaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauucccaguauguuugaaccagagcgugaaaaaguggaugccauugauggcgaauaucguuugagaggagaagcaaggaaaaccuuuguggacuuaaugaggagaggagacuuaccagucugguuggcuuacaaaguggcagcugaaggcaucaacuaugcagacagaaggugguguuucgaugggauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucgucacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccaaaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagccacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaccuacaagaaaaguggaauccaggaaguggauagaaccuuagcaaaagaaggcaucaaaagaggagaaacggaccaucacgcugugucgcgaggcucggcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugaugucuucuucaucccgccagaaaagugugacacauuguugugugacauaggggagucaucaccaaaucccacuguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguauaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugagcggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaaggccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucugcucacaccauuuccaugagcuaaucaugaaggauggucguguacuuguuguuccauguagaaaccaagaugaacugauuggcagagcccgaaucucccaaggagcaggguggucuuugcgggaaacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuuggggaaaagagaagaccaaugguguggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6911 - RNA, 9876 nt, Artificial Sequence
  derived and/or modified CDS sequence (wt) from DENV-2__FJ461321__SS-prME
ucugcaggcaugaucauuaugcugauuccaacaguaauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggagaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagagaacuuggaauacaccauugugguaacaccucacucaggggaggagcauucggucggaaaugacacaggaaaacacggcauggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauugguuacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggaucuggaaaaaagauaugucuuaggccgccuaaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucaucaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuagagaaccuaauguggaaacaaauaacaccagaauuaaaucacauucuagcagaaaaugaggugaaguugacuauuaugacaggagacaucagaggaaucaugcaggcaggaaaacgauccuugcggccucagcccacugagcuaaaguauucauggaaaacauggggcaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcgggaccauggcaccuagguaagcuugagauggacuuugauuucugcgauggaaccacagugauagugacugaggacugcggaaacagaggacccucuuugagaacaacuacugccucuggaaaacucauaacagaauggugcugccgaucuugcacauuaccaccccuaagauauagaggugaggaugggugcugguacgggauggaaaucagaccguugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagagugguggucaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccaaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccagguguuggcacuggagccuggaaaaaauccaagagccguccaaacgaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagcuauagucagagaagccauaaaacggggucugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugaucaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaagugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaggaaggggaaaggaagaaauugaaacccagaugguuggaugcuaggaucuacucugacccacuagcgcuaaaagaguucaaagaauuugcagccggaagaaagucucugacccugaaccuaaucacagaaauggguaggcuuccaacauucaugacucagaagacaagagacgcacuggauaaccuagcagugcugcacacggcugaagcagguggaagggcguacaaucaugcucucagugaacugccggagaccuuagagacacugcuuuuacugacacuucuggccacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaauguaucccuaacagcuauagccaaccaagcaacaguguuaaugggucuagggaaaggauggccauugucaaagauggacaucggaguuccccuucucgccauuggauguuacucacaagucaauccuauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaagaaguggauaggaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacgucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccaaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguuuucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguauacuuguuguuccauguagaaaccaagaugaacugauuggcagagcccgaaucucccaaggagcaggguggucuuugcgggagacggccuguuuggggaagucuuacgcccaaauguggagccugauguauuuccacaggcgugaccucagacuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6912 - RNA, 9876 nt, Artificial Sequence
  derived and/or modified CDS sequence (wt) from DENV-2__FJ410228__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggagaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagagaacuuggaauacaccauugugguaacaccucacucaggggaggagcaugcggucggaaaugacacaggaaaacacggcauggaaaucaaaguaacaccacagaguuccaucacagaagcagaauugacagguuaugguaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauugguuacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaauuccuuuugagauaauggaucuggaaaaaagauaugucuuaggccgccuaaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucaucaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacguacacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauuaaaucacauucuagcagaaaaugaggugaaguugacuauuaugacaggagacaucagaggaaucaugcaggcaggaaaacgauccuugcggccucagcccacugagcuaaaguauucauggaaaacaugggguaaagcaaaaaugcuuuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcgggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauauagaggugaggaugggugcugguacgggauggaaaucagaccguugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagagugguggucaugguaggcgccacaauggcggaugacauagguaugggcgugacuuaucuugcccuacuagcagccuucaaaguuagaccaaccuuugcagcuggacuacucuugagaaagcugaccuccaaggaauugaugaugaccaccauaggaauuguacuccucucccaaagcacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauugcaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcaguuggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccgagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcucaaacugaaaaaagcauugaagacaaccccgagaucgaagaugacauuuuccgaaagagaagacugaccaucauggaccuccacccaggagcgggaaagacgaaaagauaccuuccagcuauagucagagaagccauaaaacggggucugagaacacuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugaucaucauggacgaagcccauuucacagacccagcaaguauagcagcuagaggauacaucucaacccgaguggaaaugggugaggcagcugggauuuucaugacagcuacucccccgggaaguagagauccauuuccucagagcaaugcaccaaucauagaugaagaaagagaaaucccugaacguucauggaauucuggacaugagugggucacggauuuuaaugggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaacuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaggaaggggaaaggaagaaauugaaacccagaugguuggaugcuaggaucuacucugacccacuagcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagaccuuagagacacugcuuuuacugacacuucuggccacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauagucuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggacuaggaagcauugcaacccagcaacccgagagcaacauccuggacauagaccuacgucccgcaucagcuuggacgcuguaugccguggcuacaacauucguuacaccaaugcugagacacagcauugagaauuccucagugaauguauccuuaacagcuauagccaaccaagcaacaguguuaaugggucuagggaaaggauggccauugucaaagauggacaucggaguuccccuucucgccauuggauguuacucacaagucaauccuauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaagaaguggauaggaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaaacaagagcaugaaacgucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccaaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaagaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaacacuuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguauacuuguuguuccauguagaaaccaagaugaacugauuggcagagcccgaaucucccaaggagcaggguggucuuugcgggagacggccuguuuggggaagucuuacgcccaaauguggagccugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6913 - RNA, 9876 nt, Artificial Sequence
  derived and/or modified CDS sequence (wt) from DENV-2__FJ410233__SS-prME
ucugcaggcaugaucauuaugcugauuccaacagugauggcguuccaucuaaccacacgcaacggagaaccacacaugauugucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuuugaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucauuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaucaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuuaauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaaugacggaugacauagguaugggcgugacuuaucuugcccuacuagcagccuucaaaguuagaccaaccuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggacuggauaccauuagcauugacaaucaagggucucaacccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggagggagaagaaguccaggugcuggcacuggaaccuggaaaaaauccaagagccguccaaacaaaacccggucuuuucaaaaccaacaccggaacaauaggugcuguaucccuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacguuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugacauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccaguuauacuaacagauggugaggagcgggugauucuugcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcauuaacuaugcagacagaaggugguguuuugauggaauuaagaacaaccaaauccuggaagaaaauauggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacgcuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccggcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaguccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaauacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcauaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugaaaaacugguuggcaagaguggggcgcgaaagguugucaagaauggcuaucaguggagaugauuguguugugaaaccuuuagaugacagauucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6914 - RNA, 9876 nt, Artificial Sequence
  derived and/or modified CDS sequence (wt) from DENV-2__FJ410237__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacuuguuccacaugugggaaugggacuggagacgcgaaccgaaacauggaugucaucagaaggggcuuggaaacaugcccagagaauugaaacuuggauccugagacauccaggcuucaccauaauggcagcaauccuggcauauaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaaccugcucuucacuggacaucucaagugcagguugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugauuacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguucacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucauuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaucaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaaugacggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacguuaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggacuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcauuaacuacgcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcggugcugcacacggcugaagcagguggaagggcguacaaucaugcucucagugaacugccggagacccuagagacacugcuuuuacugacacuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuauucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaauacaagaaggggaacuggcaacaugggagagacgcuuggagagaaauggaaaagccgauugaacgcauugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagauauaaucgggaaaagaauagaaaaaauaaagcaagagcaugaaacaucauggcacuacgaccaagaccacccauacaaaacgugggcauaccaugguagcuaugaaacuaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagagaagaagcuaggggaauucggcaaggcaaaaggcagcagagccauaugguacauguggcuuggagcucgcuuccuggaguuugaagcccuaggauuccuaaaugaagaucacugguucucuagagagaacucucugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugaaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaucgauuggacacaagugccuuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacgcagauuacaugccauccaugaaaagauucagaagagaagaggaagaagcaggaguccugugguaa

SEQ ID NO: 6915 - RNA, 9876 nt, Artificial Sequence
  derived and/or modified CDS sequence (wt) from DENV-2__FJ410241__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcuguugcuccuucaaugacaaugcguugcauaggaauaucaaauagagacuuuguagaagggguuucaggaggaaguuggguugacauaguuuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacauguaagaagaacauggaagggaaaaucgugcaaccagaaaauuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccaugcaaaaucccuuuugagauaauggauuuggaaaaaagauacgucuuaggccgccugaucacagucaacccaauuguaacagaaaaagacagcccagucaacauagaagcagaaccuccauuuggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaguacaaguuccaaccagaauccccuucaaaacuagcuucagcuauccagaaagcucaagaagagggaauuugugggauucgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaagacccgaguaggaacgaaacaugcaauacuacuaguugcaguuucuuuugugacauugaucacagggaacauguccuucaaagaccuaggaagaguggugguuaugguaggcgcaacaauggcggaugacauagguaugggcgugacuuaucuugcccuacuagcagccuuuaaaguuagaccaacuuuugcagcugggcuacucuugagaaagcugaccuccaaggaauugaugaugacuaccauaggaauuguacuccucucccaaaguaccauaccagagaccguucuugaauugacugaugcguuagccuuaggcaugaugguccuuagaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuuuaaaaccaacaccggaacaauaggugcuguaucucuggacuuuuccccuggaacgucaggaucuccaauuaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagaccagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacucgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggagggaaauccaggaagguucuggaacacuaccauugcggugucaauggcuaacaucuuuagagggaguuaccuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccuuggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggccauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauauacagauuacaugccauccaugaaaagauucagaagagaagaggaagaggcaggaguccugugguaa

SEQ ID NO: 6916 - RNA, 9876 nt, Artificial Sequence
  derived and/or modified CDS sequence (wt) from DENV-2__FJ410259__SS-prME
ucugcaggcaugaucaucauguugauuccaacaguaauggcguuucaucuaaccacacgcaacggagaaccacacaugaucgucgguauacaggagaaagggaaaagucuucuguucaaaacagaggauggugugaacaugugcacccucauggcuauggaccuuggugaauugugcgaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagagaacuuggaauacaccauugugguaacaccucacucaggggaggagcaugcggucggaaaugacacaggaaagcacggcauggagaucaaaguaacaccacagaguuccaccacagaagcagaauugacagguuauggcaccgucacgauggaaugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauugguuacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaagucgugaaggaaauagcagaaacacaacauggaacgauagucaucagagugcaauaugaaggggacggcucuccauguaaaaucccuuuugagauaauggaucuggaaaaaagauaugucuuagggcgccuaaucacagucaacccaauuguaacagaaaaagauagcccagucaacauagaagcagaaccuccauucggagacagcuacaucaucauaggaguagagccgggacaacugaaacucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucaucaucacauggauaggaaugaacucacgcagcaccucauugucugugucacuaguacuggugggaauugugacacuguauuugggagucauggugcaggccgauagugguugcguuguaagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauuaaaucacauuuuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcugaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcgggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauauagaggugaggaugggugcugguacgggauggaaaucagaccguugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuagcugcagucucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguuguacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacggggucugagaacauuaaucuuggcccccacuagaguuguggcagccgaaauggaggaagcucucagaggacuuccaauaagauaccaaaccccagccaucagagcugagcacacugggcgggaaauuguggaucuaaugugucaugccacauuuaccaugaggcugcuaucaccaguuagagugccgaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguucgaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaggaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagaccuuagagacacugcuuuuacugacacuucuggccacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgccccgcaucagcuuggacgcuguaugccguggcuacaacauucguuacaccaaugcugagacacagcauugagaauuccucagugaauguaucccuaacagcuauagccaaccaagcaacaguguuaaugggucuagggaaaggauggccauugucaaagauggacaucggaguuccccuucucgccauuggauguuacucacaagucaauccuauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaagaaguggauaggaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugccucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaaacaagagcaugaaacgucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccaaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuggguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugccuuucuguucacaccauuuucaugagcuaaucaugaaggauggucguauacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6917 - RNA, 9876 nt, Artificial Sequence
  derived and/or modified CDS sequence (wt) from DENV-2__FJ547067__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacacccaggcuucaccauaauggcagcaauccuggcuuacaccauagggacaacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggacuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacacuggucacuuucaaaaauccccaugcgaagaaacaggaugucguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccaguuaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggcccugagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacuguggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaauuucuuuuguuacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauauuggcagcgguguccguuuccccacugcuuuugacauccucacagcaaaaaacggauuggauaccauuagcauugacaaucaagggucucaauccaacagcuauuuuucuaacaacccucucaagaaccaauaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaacaggcagagauaucaggaagcaguccaauccugucaauaacaauaucagaagaugguagcaugucgauaaaaaaugaagaggaagaacaaacacugaccauacuuauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacuggacgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacguugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagauugugcacacuggaaagaagccaaaaugcuccuagauaacauuaacacaccagaaggaaucauuccuaguauguuugaaccagaacgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaggcagguggaagggcguacaaucaugcucucagugaacugccggagacccuagagacacugcuuuuacugacacuucuggcuacagucacaggagggaucuuuuuauucuugaugagugggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaaccugagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuguugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcccugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccaggucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuuuaucccgccagaaaagugugacacauuguuaugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagauauaaucgggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggagaaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggaguuuuuaaaagcauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaaguccuacgcucaaauguggagcuugauguauuuccacaggcgugaccucaggcuggcagcaaaugccauuugcucggcagugccaucacacuggguuccaacaagucgaacaaccugguccauacacgccaaacaugaauggaugacaacggaagauauguugacagucuggaacaggguguggauucgagaaaacccauggauggaagacaaaaccccaguggaaucaugggaggaaaucccauauuugggaaaaagagaagaucaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6918 - RNA, 9876 nt, Artificial Sequence
  derived and/or modified CDS sequence (wt) from DENV-2__JN819418__SS-prME
acagcaggcgugauuauuauguugauuccaacagccauggcguuccauuuaaccacacguaauggagaaccacacaugaucguugguaggcaagagaaagggaaaagucuucuguucaaaacagaggauggugugaacauguguacccucauggccauagaucuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucgucccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugauuuucaucuuacugacagcugucgcuccuucaaugacaaugcguugcauaggaauaucaaauagagacuuuguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguuugucugcaaacacuccaugguagacagaggauggggaaauggauguggauuauuuggaaagggaggcauugugaccugugcuauguucacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcauagacaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggagccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacaugucuuaggucgccugauuacaguuaacccgaucguaacagaaaaagauagcccagucaacauagaagcagaaccuccauucggagacagcuacaucaucauaggaguagagccgggacaauugaaacucaacugguuuaagaagggaaguuccaucggccaaauguuugagacaacaaugagaggagcgaagagaauggccauuuuaggugacacagccugggacuuuggaucucugggaggaguguuuacaucuauaggaaaggcucuccaccaaguuuucggagcaaucuauggggcugccuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaagcgaucuuugcggccccagcccacugagcugaaguacucauggaaaacauggggaaaggcgaaaaugcucuccacagagucucacaaccagaccuuucucauugauggcccugaaacagcagaaugccccaacacaaacagagcuuggaacucgcuggaaguugaagacuaugguuuuggaguuuuuuccaccaauauauggcuaaaauugagagaaaaacaggauguauuuugugacucaaaacucaugucagcggccauaaaagacaacagagccguccaugccgacauggguuauuggauagaaagugcacucaaugacacauggaagauggagaaagccucuuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugccgauccugcacauugccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuucaugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacugcucuugagaaaacugaccuccaaggaauuaaugauggccaccauaggaaucgcacuccuuucccaaagcaccauaccagagaccauucuugaacugacugaugcguuagccuuggguaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuuaaugaggcuaucauggcagucgggauggugagcauuuuagccaguucucuucuaaagaaugacauucccaugacagguccauuaguggcuggagggcuccucacuguguguuacgugcucacuggacgaucggccgauuuggaacuggagagagcugccgaugucaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggacucuuuccaguaucgauaccaauuacggcagcagcaugguaccugugggaagugaagaaacaacgggcuggaguauugugggacgucccuucacccccacccgugggaaaagccgaacuggaagacggagccuauagaaucaagcaaagagggauucuuggauauucucagauuggagccggagucuacaaagaaggaacauuccauacaauguggcaugucacacguggugcuguucugaugcauagagggaagaggauugaaccaucaugggcagacguuaagaaagaccuaauaucauauggaggaggcuggaagcuagaaggagaauggaaggaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuauggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcccccacuagagucguagcagcugaaauggaggaagcucuuagaggacuuccaauaagauaccaaaccccagccaucagagcugagcacaccgggcgggagaucguggaccuaaugugucaugccacauuuacuaugaggcugcugucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucuggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugagggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaagucuuugacccugaaccuaaucacagaaauggguaggcuuccaacuuucaugacucagaaggcaagagacgcacuggauaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagaugggcuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugugucccuaacagccauugcuaaccaagccacaguacuaaugggucuugggaaaggauggccauugucaaagauggacaucggaguuccccuccuugcuauuggaugcuacucacaagucaacccuauaacucuuacagcagcucuucuuuuauugguggcacauuaugccauuauagggccaggacuucaagcaaaagcaaccagagaagcucagaaaagagcagcagcaggcaucaugaaaaacccaacagucgauggaauaacagugauugaccuagauccaauacccuaugauccaaaauuugaaaagcaguuaggacaaguaaugcuccuaauccucugugugacucaaguauuaaugaugaggacuacaugggcucugugugaggcucuaaccuuagcgaccgggcccaucuccacacugugggaaggaaauccagggagguuuuggaacacuaccauugcagugucaauggcuaacaucuuuagagggagcuauuuggccggagcuggacuucucuuuuccaucaugaagaacacaacaaacacaagaagaggaacuggcaacauaggagagacacuuggagaaaaauggaaaagccgauugaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacuaaaaaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucuuaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggaugcugauuaacagauucacaaugaaacacaagaaagccaccuacgagccagauguugaccuaggaagcggaacucgcaacauuggaauugaaagugagauaccaaaucuagacauaauaggaaagagaauagagaaaauaaagcaagagcaugaaacaucauggcacuaugaccaagaccauccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccuuuuggacaacaacgcguuuucaaagagaaaguggacacgagaacccaagaaccgaaggaaggcacaaagaaacugaugaaaaucacggcagaguggcuuuggaaagaacuaggaaagaaaaagacaccuaggauguguaccagagaagaauucacaagaaaggugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagagaacucccugaguggaguggaaggagaagggcugcacaagcuaggcuacaucuuaagagacgugagcaaaaaggaagggggagcaauguacgccgaugauacagcaggaugggacacaagaaucacacuagaagacuuaaaaaaugaagaaaugguaacaaaccacauggaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaacauggaagcccaauuaauuagacagauggagggagaaggaaucuucaaaagcauucagcaccugacagucacagaagaaaucgcuguacagaacugguuggcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucaagaggauggaacgauuggacacaagugccuuucuguucacaccauuuucaugaguuaaucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccuuagacuggcggcuaaugcuauuugcucggcagucccgucacauuggguuccaacaagucgaacaaccugguccauacacgcuaagcaugaauggaugacgacggaagacaugcuggcagucuggaauaggguguggauccaagaaaacccauggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6919 - RNA, 9876 nt, Artificial Sequence
  derived and/or modified CDS sequence (wt) from DENV-2__EU482640__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuacgggacaugcaccgccacaggagaacacagaagggaaaaaagaucaguggcacuaguuccacaugugggaaugggacuggagacacgaacugaaacauggaugucaucagaaggggccuggaaacaugcccagagaauugaaacuugggucuugagacauccaggcuucaccauaauggcagcaauccuggcuuacaccauaggaacgacauauuuccaaagaguccugaucuuuaucuuacugacaacugucgcuccuucaaugacaaugcguuguauaggaauaucaaauagagacuuuguggaagggguaucaggaggaagcuggguugacauagucuuggaacauggaagcugugugacgacgauggcaaaaaauaaaccaacauuggauuuugaacugauaaaaacagaagccaaacacccugccacucuaagaaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacuguuacgauggaaugcucuccgagaacgggccucgauuucaaugagaugguguugcugcaaauggaaaacaaggcuuggcuggugcacaggcaaugguucuuagaccugccauuaccauggcugcccggagcagacacacaaggaucaaauuggauacagaaggagacauuggucacuuucaaaaauccccaugcaaagaaacaggauguugucguuuuaggaucccaagaaggggccaugcacacagcacucacaggggccacggaaauccagaugucaucaggaaacuugcuguucacaggacaucuuaagugcaggcugagaauggacaaacuacagcucaaaggaaugucauauuccaugugcacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaauugucacagaaaaagacagcccaguuaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuugggagggguguucacauccauaggaaaggcccuccaccaagucuuuggagcaaucuauggggcugccuucagugggguuucauggaccaugaaaauccucauaggagucgucaucacauggauaggaaugaauucacgcagcaccucacugucugugucacuaguguuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuggagaaucugauguggagacaaauaacaccagaauugaaucauauucuaucagaaaaugagguaaaguugacuaucaugacaggagacauuaaaggaaucaugcaggcaggaaaacgaucccugcggccucaacccacugagcugaaguacucuuggaaagcauggggcaaagcgaaaaugcuuuccacagagcuucacaaccacaccuuucucauugauggccccgaaacagcagaaugucccaacacaaacagagcuuggaacucacuagaaguugaagacuauggcuuuggaguauuuaccaccaacauauggcugaaauugaaagaaaggcaggauguauuuugugacucaaaacucaugucagcagccauaaaagacagcagagccguccacgccgauauggguuacuggauagaaagcgcacucaaugacacauggaagauugagaaagccucuuuuauugaaguuaagagcugccacuggccaaagucacacacucucuggaguaauggagugcuagaaagugagaugauaauuccaaagaauuuugcaggaccagugucacaacacaauuacagaccaggcuaucauacacaaacggcaggacccuggcauuuaggcaggcuugagauggacuucgauuucugcgaaggaaccacagugguggugacugaggacuguggaaauagaggacccucuuuaagaacaacuacugcuucuggaaaacucauaacagagugguguugccgaucuugcacauuaccaccgcuaagguacagaggugaggauggaugcugguauggaauggaaauuagaccauugaaagagaaagaagagaacuuggucaacucuuuggucacagccggacauggacagauugauaacuuuucacuaggagucuugggaauggcacuguuccuggaagagaugcucaggacccgaauaggaacgaaacaugcaauauuauuaguugcaguuucuuucgugacauugaucacagggaacauguccuuucgagauuuggggagagugauggucauggugggcgcuacuaugacggaugacauaggcaugggcgugacuuaucucgcccuauuagcagccuucaaagucagaccaacuuuugcagcuggacuacucuuaagaaagcugaccuccaaggaauugaugaugaccaccauaggaaucgugcuccucucccagagcaccguaccagagacuauacuugaacugacugacgcguuggcuuugggaaugaugguucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacggcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcaucuuagccaguucucucuuaaagaaugauauucccaugacaggaccauuaguggcuggagggcuucucacuguguguuacgugcucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuggugauaucaggacuuuuucccgugucaauaccaaucacggcagcugcaugguaccugugggaagugaaaaaacaacgagcaggaguauugugggaugucccuucacccccaccugugggaaaggccgaacuggaagauggagccuauagaaucaagcagaaagggauucuaggauacucgcagaucggagcuggaguuuacaaagaaggaacauuucacacaauguggcaugucacacguggugcuguccuaaugcauaaagggaagagaauugaaccaucaugggcggacgucaagaaagaucuaauaucguauggaggaggcuggaagcuagaaggagaauggaaggaaggagaagaaguccaaguccuggcauuagagccuggaaagaauccaagagccguccaaacaaaacccggccuuuuuaaaacuaacacuggaaccauaggcgccgugucucuggacuuuucuccuggaacgucaggaucuccaaucgucgacaaaaaaggaaaaguugugggccuuuauggcaacggugucguuacaaggaguggaacauaugugagugcuauagcccagacugaaaaaagcauugaagacaauccagagauugaagaugacaucuuucgaaagaaaagauugaccaucauggaccuccacccaggagcaggaaaaacaaagagauaccuuccagcaauagucagggaagccauaaaacgaggcuugagaacacuaaucuuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacugucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauuuccucagagcaaugcaccaaucauggaugaagaaagggaaaucccugagcguucguggaacucuggacaugaguggguuacggauuuuaaagggaagacuguuugguucguuccaaguauaaaagcagggaaugacauagcagcuugccugagaaagaauggaaagaaagugauacaacucagcaggaagacuuuugauucugaauauauuaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugagaaugaccaguacauauacaugggggaaccucuggaaaaugacgaagacugugcacacuggaaagaagcuaaaaugcuucuagacaacaucaacacgccugaaggaaucauucccagcauguucgaaccagagcgugaaaagguggaugccauugauggugaauaccgcuugagaggagaagcgaggaaaacuuucguggaccuaaugagaagaggagaccuaccagucugguuagccuacagaguggcagcugaagguaucaauuacgcagacagaagauggugcuuugauggagucaagaacaaccaaaucuuggaagaaaauguggaaguggaaaucuggacaaaagaaggagaaaggaagaaacuaaaacccagaugguuggaugccaggaucuacucugacccauuggcgcucaaagaauucaaggaauucgcagcuggaagaaagucccugacccugaaucuaaucacagagauggguaggcucccaaccuucaugacccagaaagcaaggaaugcacuggauaacuuagcagucuugcauacagcugaagcaggcggaagggcguauaaucaugcucuuagugaacugccggagacucuggagacauugcuuuuacugacacucuuggccacagucacgggcggaaucuuccuguucuugaugagcggaaaagguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaaacagagaacaccccaagauaaucaauuaacuuauguugucauagccauccuuacagugguggccgcaaccauggcaaacgagauggguuuccuggaaaaaacaaagaaagauuucggauugggaagcauuacaacccagcaaccugagagcaacauccuggacauagaucuacguccugcaucagcuuggacucuauaugccguggcaacaacuuucaucacaccaauguugagacauagcauugaaaauuccucaguaaaugugucucuaacagccauugccaaccaagccacaguguuaaugggucuugggaaaggauggccauugucaaaaauggacaucggaguuccccuucucgcuaucgggugcuauucacaagucaaccccauaacucucacagcagcccuucuccuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugugugacucaaguauugaugaugaggacuacaugggccuuaugugaagcucuaaccuuagcaaccgggcccaucucuacacugugggaaggaaauccaggaagauucuggaauacaacuauugcagugucaauggcuaacauuuuuagagggaguuaccuggccggagccggacuucucuuuucuaucaugaagaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacugaccaucacgcugugucgcgaggcucggcgaaacugagaugguucgucgagagaaaccuggucacaccagaagggaaaguaguggaccuugguuguggcagggggggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuucuuuacuccgccagaaaagugugacacauugcugugugacauaggggagucgucaccaaaccccacgguugaagcaggacggacacucagaguuuuaaacuuaguggaaaauuggcugaacaauaacacccaauuuugcauaaagguucucaacccauauaugcccucaguuauagaaaaaauggaagcgcuacaaaggaaauacggaggagcuuuggugaggaauccacucucacgaaauuccacacacgagauguacuggguguccaaugcuuccgggaacauagugucaucagugaauaugauuucaagaauguugauuaacagauucacaaugagacacaagaaggccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacguuaucccuauggugacacagauggcaaugacagacacgacuccauuuggacaacagcguguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaaguaaugcagccuuaggcgccauauucacugaugagaacaaguggaagucggcacgugaggcuguugaagacaguggauuuugggaauugguugacaaggaaaggaaucuccaucuugaaggaaagugugagacauguguauauaacaugaugggaaagagagagaagaagcuaggggaguucggcaaagcgaaaggcagcagagccauaugguacauguggcuuggagcacgcuucuuagaguuugaagcccuaggauucuugaaugaagaucacugguuuuccagagagaacucccugaguggaguggaaggagaagggcugcacaaauuaggcuacauuuuaagagacgugaguaagaaagaaggaggagcaauguacgccgaugacaccgcaggaugggauacaagaaucacacuagaggauuugaaaaaugaagaaauggugacaaaccacauggaaggagaacacaagaaacuugcugaagccaucuucaaauuaacguaccaaaacaagguggugcgcgugcaaagaccaacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaacugacagucacagaagaaauugcagugaaaaacugguuagcaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugccuuuuuguucacaccauuuccaugaguuaaucaugaaggacggucguguacucguaguuccaugcagaaaucaagaugaacugauugguagggcccgaauuucccagggagccgggugguccaugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagguuuagaagagaagaggaagaggcaggagucuugugguag

SEQ ID NO: 6920 - RNA, 9876 nt, Artificial Sequence
  derived and/or modified CDS sequence (wt) from DENV-2__EU482641__SS-prME
ucugcaggcaugaucauuaugcugauuccaacaguaauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccauuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaaguugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagagaacuuggaauacaccauugugguaacaccucacucaggggaggagcaugcggucggaaaugacacaggaaaacacggcauggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauugguuacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggauaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggaucuggaaaaaagauaugucuuaggccgccuaaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucaucaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauuaaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggcuauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcgggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauauagaggugaggaugggugcugguacgggauggaaaucagaccguugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggaaccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacggggucugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuuuaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaaccgacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaggaaggggaaagaaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagaccuuagagacacugcuuuuacugacacuucuggccacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaauguaucccuaacagcuauagccaaccaagcaacaguguuaaugggucuagggaaaggauggccauugucaaagauggacaucggaguuccccuucucgccauuggauguuacucacaagucaauccuauaacucucacagcagcccuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaagaaguggauaggaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacgucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccaaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaccuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagagguacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguauacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacaugccaaacaugaauggaugacaacggaagacauguugacagucuggaacaggguguggauucgagaaaacccauggauggaagacaaaacuccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6921 - RNA, 9876 nt, Artificial Sequence
  derived and/or modified CDS sequence (wt) from DENV-2__EU482642__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccaugcaaaaucccuuuugagauaauggauuuggaaaaaagauaugucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccuccuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguuuuugaauugacugaugcguuagccuuaggcaugaugguccuuaaaauaguaagaaacauggaaaaguaucaauuagcagugacuaucauggccaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucagggagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaagggaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugaaugggucacggauuuuaaagggaagacuguuugguucguuccaagcauaaaagcaggaaaugauauagcagcuugccugagaaaaaauggaaagaaaguaauacaacuuaguaggaagacuuuugauuccgaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccuuuggaaaaugaugaagacugugcacacuggaaagaagccaaaaugcuccuagauaacauuaacacaccagaaggaaucauuccuaguauguuugaaccagagcgugaaaaaguggaugccaucgauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaauauccuggacauagaccuacgccccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacuugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuggcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugauacauuguugugugacauaggggagucaucgccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguaucuaaugcuucugggaacauagugucaucagugaacaugauuucaaggauguugaucaauagauucacaaugagacacaagaaagccacuuacgaaccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaauuaaugaaaaucacagcagaguggcuauggaaagaauuagggaagaaaaagacaccuaggauaugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacugacguaucaaaacaagguggugcgugugcaaagaccaacaccaagaggaacaguaauggacaucauaucgagaaaagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucgugugcuuguuguuccauguagaaaccaagaugaacugauuggcagagcccgaaucucccaaggagcaggguggucuuugcgggagacggccuguuuggggaaguccuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucaagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6922 - RNA, 9876 nt, Artificial Sequence
  derived and/or modified CDS sequence (wt) from DENV-2__EU482643__SS-prME
ucggcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagccgucgcuccuucaaugacaaugcguugcauaggaauaucaaauagagacuuuguagaagggguuucaggaggaaguuggguugacauagucuuagaacauggaagcugugugacgacgauggcaaaaaacaaaccaacgcuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagaugaaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccauguguacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauugugacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcgaagagaauggccauuuugggugacacagccugggacuuuggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauaacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacgacagagugcccuaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugcugacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacacgaguaggaacgaaacaugcaauacuacuaguuacaguuucuuuugugacauugaucacagggaacauguccuucaaagaccuaggaagagugguggucaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagcuuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagauuuaauaucauauggaggaggcuggaagcuagaaggagaauggaaggaaggagaagaaguccagguguuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuacgguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagcuaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagcuacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagccgaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacaguuacaggagggauuuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuacguuguaauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccguugauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaagaacguaagagaagugaaaggccuaacaaaaggaggaccaggacacgaagaacccaucccuaugucaacauauggguggaaucuggugcgucuucagaguggaguugacgucuuuuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguaguuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuaggcuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccuggucuauacacgccaaacaugaauggaugacaacggaagacauguugacagucuggaacaggguguggauucgagauaacccauggauggaagacaaaaccccaguggaaucaugggaggaaaucccauacuugggaaaaagagaagaccaauggugcggcucauugauuggguuaacaaguagggccacaugggcaaagaacauccaagcagcaauaaaucagguuagaucucuuaugggcaaugaggaauacacagauuacaugccauccaugaaaagauucagaagagaagaggaagaagcaggaguccugugguaa

SEQ ID NO: 6923 - RNA, 9876 nt, Artificial Sequence
  derived and/or modified CDS sequence (wt) from DENV-2__EU482644__SS-prME
ucugcaggcaugaucauuaugcugauuccaacagugauggcguuccaucuaaccacacgcaacggagaaccacacaugaucgucgguauacaggagaaaggaaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauugggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucuguaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccauuacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcacacagcacucacaggagccacagaaauccaaaugucgucaggaaacuugcucuucacuggacaucucaaguguaggcugagaauggacaagcuacagcuuaaaggaaugucauacuccaugugcaccggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccgaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguacgggcgugacuuaucuugcccuacuagcagccuucaaaguuagaccaacuuuugcagcugggcuacucuugagaaagcugaccuccaaggaauugaugaugacuaccauaggaauuguacuccucucucaaaguacuauaccagagaccguucuugaauugacugaugcguuagccuuaggcaugaugguccuuaaaauaguaagaaacauggaaaaguaucaauuagcagugacuaucaugacuaucuugugcgucccaaacgcagugauauuacaaaaugcauggaaagugaguugcacaauacuggcagugguguccgucuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcggcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucacacaauguggcaugucacacguggcgcuguucuaaugcauaaaggaaagaggauugaaccuucaugggcggacgucaaaaaagaucuaauaucauauggaggaggcuggaagcuggaaggagaauggaaggaaggagaagaaguccaggugcuggcacuggagccuggaaaaaauccaagagccguucaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguagaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagcgcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuugccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuaggaaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaauaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacaaauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccaugcagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6924 - RNA, 9876 nt, Artificial Sequence
  derived and/or modified CDS sequence (wt) from DENV-2__EU482645__SS-prME
ucugcaggcaugaucauuaugcugauuccaacagugauggcguuccaucuaaccacacgcaacggagaaccacacaugaucgucgguauacaggagaaaggaaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauugggacgacacauuuccagaaaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucuguaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccauuacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcacacagcacucacaggagccacagaaauccaaaugucgucaggaaacuugcucuucacuggacaucucaaguguaggcugagaauggacaagcuacagcuuaaaggaaugucauacuccaugugcaccggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccgaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguacgggcgugacuuaucuugcccuacuagcagccuucaaaguuagaccaacuuuugcagcugggcuacucuugagaaagcugaccuccaaggaauugaugaugacuaccauaggaauuguacuccucucucaaaguacuauaccagagaccguucuugaauugacugaugcguuagccuuaggcaugaugguccuuaaaauaguaagaaacauggaaaaguaucaauuagcagugacuaucaugacuaucuugugcgucccaaacgcagugauauuacaaaaugcauggaaagugaguugcacaauacuggcagugguguccgucuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcggcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucacacaauguggcaugucacacguggcgcuguucuaaugcauaaaggaaagaggauugaaccuucaugggcggacgucaaaaaagaucuaauaucauauggaggaggcuggaagcuggaaggagaauggaaggaaggagaagaaguccaggugcuggcacuggagccuggaaaaaauccaagagccguucaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguagaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagcgcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuugccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuaggaaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggauuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacaaauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuuuaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccaugcagaaaccaagaugaacugauuggcagagcccgaaucucccaaggagcaggguggucuuugcgggagacggccugucuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcgggaguccugugguaa

SEQ ID NO: 6925 - RNA, 9876 nt, Artificial Sequence
  derived and/or modified CDS sequence (wt) from DENV-2__EU482646__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaauaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucaucugcaaacacuccaugguagacagaggauggggaaauggauguggacuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacaguuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguacuugggagucauggugcaggccgauagugguugcguugugagcuggaaaaacaaagaacugaaauguggcagugggauuuucaucacagacaacgugcacacauggacagaacaguacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucauucauugagguaaaaaacugccacuggccaaaaucacacacccucuggaguaacggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaauauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggagggggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuagacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggaaaugggugaggcagcugggauuuucaugacagccacucccccgggaaguagagauccauucccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaagguggaugccauugauggcgaauaccguuugagaggagaagcaaggaaaacauuuguggacuugaugaggagaggagacuuaccaguuugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaccacggcuagcauccuucuaugguacgcacaaauacagccacacuggauagcagccucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacguccugcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagagaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacgugagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauacaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucugcucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6926 - RNA, 9876 nt, Artificial Sequence
  derived and/or modified CDS sequence (wt) from DENV-2__EU482647__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauauucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagaugaaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguucuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaauauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaaugugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauuuuagcggaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaagcucaugucggcggccauaaaagacaacagagccguccaugccgacauggguuacuggauagaaagugcacucaaugacacauggaagauagagaaagccucuuucauugaaguaaaaaacugucacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucaggaaaacucauaacagaauggugcugccgaucuugcacacuaccaccccuaagauacagaggugaagaugggugcugguacgggauggaaaucagaccauugaaagagaaagaagaaaaucugguuaacuccuuggucacagccggacaugggcagguugacaauuuuucacugggagucuugggaauggcauuguucuuggaggaaaugcuuaggacccgaguaggaacgaaacaugcaauacuacuaguugcaguuucuuuugugacacugaucacagggaacauguccuucaaagaccuaggaagaguggugguuaugguaggcgcuacaauggcggaugauauaggcaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagcuauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggugcuguccuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaauuaucgacaaaaaaggaaaaguugugggucuuuaugguaaugguguugucacaaggaguggagcauauguaagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacccccccaggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaucguuugagaggagaagcaaggaaaaccuuuguggacuuaaugaggagaggagacuuaccagucugguuggcuuacaaaguggcagcugaaggcaucaacuaugcagacagaaggugguguuuugaugggauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacuccuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaacugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucgucacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggcuuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaccuacaagaaaaguggaauccaggaaguggauagaaccuuagcaaaagaaggcaucaaaagaggagaaacggaccaucacgcugugucgcgaggcucggcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaagcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaaggccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggaaacggccuguuuggggaagucuuacgcccaaauguggagcuugauguauuuccacaggcgugaccucaggcuggcggcaaaugccauuugcucagcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaaugguguggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6927 - RNA, 9876 nt, Artificial Sequence
  derived and/or modified CDS sequence (wt) from DENV-2__EU482648__SS-prME
acagcaggcgugauuauuauguugauuccaacagcgauggcguuccaucuaaccacacguaauggagaaccacacaugaucguugguagacaagagaaagggaaaagucuucuguucaaaacggaggauggugugaacauguguacccucauggccauagaucuuggugaauugugugaagauacaaucacguacaagugcccccuccucaggcagaaugaaccagaagacauagauuguugguguaacuccacguccacauggguaacuuaugggacgugcaccaccacaggagaacacagaagagaaaaaagaucaguggcacucguuccacauguggguaugggacuggagacacgaacugaaacauggaugucgucagaaggagccuggaaacacgcucagagaauugaaaccuggaucuugagacauccaggcuuuaccauaauggcagcaauccuggcauacaccauaggaacgacacauuuccaaagggcccugauuuucaucuuacugacagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacagaagccaaacaaccugccacuuuaaggaaguacuguauagaagcaaagcugaccaacacaacaacagaaucucguugcccaacacaaggggaacccagucuaaaugaagagcaggacaaaagguucgucugcaaacacuccaugguggacagaggauggggaaauggauguggauuauuuggaaagggaggcaucgugaccugugcuauguuuacaugcaaaaagaacauggaaggaaaaaucgugcagccggaaaauuuggaauacaccaucgugauaacaccccacucaggagaagagcaugcuguagguaaugacacaggaaaacaugguaaggaaaucaaaauaacaccacagaguuccaucacagaagcagaacugacaggcuauggcacaguuacgauggagugcucuccgagaacgggccuugacuuuaaugagauggugcugcugcagauggaagacaaagcuuggcuggugcacaggcagugguuccuagaccugccguuaccauggcuacccggagcggacacacaaggaucaaauuggauacagaaagagacacuggucaccuucaaaaauccucacgcgaagaaacaggaugucguuguuuuaggaucucaagaaggggccaugcacacggcacucacaggggccacagagauccagaugucaucaggaaacuuacuauucacaggacaucucaagugcaggcugagaauggacaaacuacagcucaaaggaaugucguacucuaugugcacaggaaaguucaaaauugugaaggaaauagcagaaacacaacauggaacaauaguuauuagaguacaauaugaaggagacggcucuccauguaagaucccuuuugaaauaauggauuuagaaaaaagacauguuuuaggucgccugauuacaguuaacccgaucguaacagaaaaagauagcccagucaacauagaagcagaaccuccauucggagacagcuacaucauuauaggaguagagccgggacaauugaaacucaacugguuuaagaaaggaaguuccauuggccaaauguuugagacaacaaugagaggagcgaagaggauggccaucuuaggugacacagccugggauuuuggaucccuaggaggaguguuuacaucuauaggaaaagcucuccaccaaguuuucggagcaaucuauggggcugccuuuaguggggucucauggacuaugaaaauccucauaggagccaucaucacauggauaggaaugaauucacguagcaccucacugucugugucacuaguauuggugggagucauaacacuguacuugggagccauggugcaggcugauagugguugcguugugagcuggaaaaacaaagaacugaaauguggcagcgggaucuucaucacagauaacgugcacacauggacagagcaauacaaguuccaaccagaauccccuucaaaauuagcuucagcuauccagaaagcucaugaagagggcauuugugggauucguucaguaacaagauuggagaaucugauguggaaacaaauaacaccagaauugaaccacauucuaucagaaaaugagguaaaguugaccaucaugacaggagauauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuauggcuuuggaguuuucaccaccaacauauggcuaaaauugagagaaaaacaggauguguuuugugacucaaaacucaugucagcagccauaaaagacaacagagccguccaugccgauauggguuacuggauagaaagugcacucaaugacacauggaagauggaaaaggccuccuucauugaaguuaaaagcugccacuggccaaagucacacacccucuggagcaauggaguauuagaaagugagaugauaauuccaaaaaguuuugcugggccagugucacaacacaacuacagaccaggcuauuacacgcaaacagcaggaccuuggcaucuagguaagcucgaaauggacuuugauuucugcgaaggaacuacagugguggugacugaggacugcggaaauagaggacccucuuuaagaacgaccacugccucuggaaaacuuauaacagaauggugcugccgauccugcacauuaccaccucuaagauacagaggugaggauggaugcugguaugggauggaaaucagaccauuaaaagagaaagaagagaauuuggucaacuccuuggucacagcaggacaugggcagauugacaacuucucacuaggagucuugggaauggcacuauucuuggaagaaaugcucaggacacgaguaggaacgaaacaugcaauacugcuaguugcaguuuccuuuaugacauugauuacugggaacauguccuuuagagaccugggaagagugaugguuauggugggcgcuaccaugacggaugacauagguaugggagugacuuaucuugcccuacuggcagcuuucaaaguuagaccaacuuuugcagcuggacuacuacugagaaagcugaccuccaaggaauuaaugauggcuaccauaggaauugcacuccuuucucaaagcaccauaccagagaccauucuugaacuaacugaugcguuagccuugggcaugaugguccuaaaaauagugagaaauauggaaaaguaccaauuggcagugacuaucauggcuaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccaucuuucuaacaacucuuucgagaaccagcaagaaaaggagcuggccacuaaaugaggcuaucauggcugucgggauggugagcauuuuagccaguucccucuuaaaaaaugacauucccaugacagguccauuaguggcuggagggcuccuuacugugugcuacgugcucacuggacgaucggccgauuuggaacuggagagagccaccgaugucaaaugggaagaucaggcagaaauaucaggaagcagcccaauccugucaauaacaauaucagaagauggcagcaugucgauaaagaaugaagaggaagaacaaacacugaccauacucaucagaacgggauugcuagugaucucaggacucuuuccagugucaauaccaauuacggcagcagcaugguaccugugggaagugaagaaacaacgggcuggaguauugugggacgucccuucacccccacccgugggaaaggcugaacuggaagauggagccuauagaaucaagcagaaagggauucuuggauacucccagauuggagccggaguuuacaaagaaggaacauuccauacaauguggcacgucacacguggcgcuguucugaugcauagagggaagaggauugaaccaucaugggcggacgucaagaaagaccuaauaucauauggaggaggcuggaaacucgaaggagaauggaaggaaggagaggaaguccaaguccuggcauuggaaccuggaaaaaauccaagagcuguucaaacgaaaccuggacuuuucaaaaccaacaccggaaccauaggcgccguaucucuggacuuuucuccuggaacgucaggauccccaauugucgacagaaaaggaaaaguugugggucuuuauggcaaugguguugucacaaggaguggagcauacgugagugcuauagcccagaccgaaaaaagcauugaagacaauccagagauugaagaugacauuuuccgaaagaaaagauugacuaucauggaccuccauccaggagcgggaaagacaaaaagauaccuuccagccauaguuagagaggccauaaaacguggcuuaagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacguuuacuaugaggcugcuaucaccagucagagugccaaauuacaaccugaucaucauggaugaagcucacuucacagacccagcaagcauagcagcuagaggauacauuucaacucgaguagagaugggugaagcagcugggauuuucaugacagccacuccuccgggaaguagagacccauuuccucagagcaaugcaccaaucauagaugaggaaagagaaaucccugagcguucguggaacucuggacaugaaugggucacggauuuuaaagggaagacuguuugguuuguuccaaguauaaaagcgggaaaugacauagcagcuugucucaggaaaaauggaaagaaagugauacaacucagcaggaagaccuuugacucugaguauguuaagacuaggaccaaugauugggacuuuguggucacaaccgacauuucagaaaugggugcuaacuucaaggcugagaggguuauagaccccagacguugcaugaaaccaguuauacuaacagauggugaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcgcauuggaaagaagcuaaaaugcuccuagauaacaucaacacaccugaaggaaucauuccuaguauguucgaaccagagcgugaaaagguggaugccauugauggugaauaccgcuugagaggagaagcaaggaaaaccuuuguggaccuaaugagaagaggggacuuaccagucuggcuggccuacagaguggcagcugaaggcaucaacuacgcagacagaaggugguguuuugauggaguuaagaauaaccaaauacuggaagaaaacguggaaguggaaauuuggacaaaagagggggaaaggaagaaauuaaaacccagaugguuggacgcuaggaucuauucugacccacuggcacuaaaagaauucaaggaauuugcagcuggaagaaagucccuaacccugaaccuaaucacagaaauggguaggcuuccaacuuucaugacucaaaaagcaagagaugcacuggauaaccuagcugugcugcauacggcugaggcagguggaagagcguacaaucaugcucucagugaacugccggagacccuggagacacugcuuuuacugacacuucuggcuacagucacgggaggaaucuucuuauucuuaaugagcggaaaagguguagggaagaugacccugggaaugugcugcauaaucacggcuagcauccuccuaugguaugcacagauacaaccacacuggauagccgcuucaauaauauuggaguuuuuucucauaguuuugcucauuccagaaccagaaaaacagagaacaccccaagauaaccaauugaccuacguugucauagccauccucacaguaguggccgcaaccauggcaaacgaaauggguuuucuggaaaaaaccaagaaagaccucggacugggaagcauugcaacucaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuccuugccauuggauguuacucacaagucaaccccauaacucucacagcagcucuucuuuuauugauagcacauuaugccauuauagggccaggacuucaagcgaaagcaaccagagaagcucagaaaagagcagcagcaggcaucaugaaaaacccaacagucgauggaauaacagugaucgaccuagauccaauacccuaugauccaaaauuugaaaaacaguuaggacaaguaaugcuccuaauucucugcgugacucaaguauuaaugaugaggacuacaugggcucugugugaggcucuaaccuuagcgaccgggcccaucuccacauugugggaaggcaauccagggagguuuuggaacacuaccauugcagugucaauggcuaacauuuuuagagggagcuacuuggcuggagcuggacuucuuuuuuccaucaugaagaauacaacaaauacaagaagaggaacuggcaacauaggagagacgcuuggagagaaauggaaaagccgauugaacgcacugggaaaaagugaauuucagauuuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugugguagagggggcuggucauacuauugugggggacuaaagaauguaagagaagucaaaggccugacaaaaggaggaccaggacacgaggaaccuauccccaugucaacauauggguggaaucuaguacgucugcagaguggaguugauguuuucuucacuccgccagaaaagugugacacacuguugugugacauaggggagucgucaccaaaucccacgauagaagcaggacgaacacucagaguccucagcuugguggaaaauugguugaacaaugacacucaauuuugcauaaagguucucaacccauacaugcccucaguuauagaaaaaauggaaacacugcagaggaaauauggaggagccuuagugaggaauccacucucacgaaacuccacacaugagauguacuggguauccaaugcuacuggaaacauagugucaucagugaacaugauuucaaggaugcugauuaacagauucacaaugaaacacaagaaagccaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauauaaaacaugggcuuaccauggcagcuaugaaacaaaacagacuggaucagcaucauccauggugaacggaguggucagacuacugacaaaaccuugggacgucgucccuaugguaacacagauggcaaugacagauacgaccccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggagccauauucacugaugagaacaaauggaagucggcacgcgaggcuguugaagauaguagguuuugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuucuuggaguuugaagcccugggauucuugaaugaagaucacugguucucuagagagaacucccugaguggaguggaaggagaagggcugcacaagcuaggcuacauucuaagagacgugagcaagaaggaaggaggagcaauguacgcugaugauacagcaggaugggacacaagaaucacacuagaggacuuaaaaaaugaagaaauggugacaaaccacauggaaggagaacacaagagacuagccgaggccauauuuaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaauuuucaaaagcauucagcaccugacagucacagaagaaaucgcuguacagaacugguuggcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucaaaaggauggaacgauuggacacaagugccuuucuguucacaccauuuucaugaguuaaucaugaaagacggccgcgugcuugugguuccaugcagaaaccaagaugaacugauuggcagggcccgaauuucucagggagcuggguggucuuugaaggagacugccuguuuggggaagucuuacgcccaaauguggagccugauguacuuccacagacgugaccucaggcuggcggcaaaugcuauuugcucggcagucccgucacauuggguuccuacaagucgaacaaccuggucuauacacgccaaacaugaauggaugacgacggaagacaugcugacagucuggaacaggguguggauccaagaaaacccauggauggaagacaaaacuccaguggagucaugggaggaagucccauauuugggaaaaagagaagaccaauggugcggcucauugauugggcuaacaagcagggcuaccugggcaaagaacauccaaacagcaauaaaucaagucagaucccuuauaggcaaugaagaauacacagauuacaugccauccaugaagagauucagaagggaagaggaagaggcagguguccugugguag

SEQ ID NO: 6928 - RNA, 9876 nt, Artificial Sequence
  derived and/or modified CDS sequence (wt) from DENV-2__EU482649__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcuaucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacucuaaggaaguacugcauagaagcaaaguuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucgaauuggauacagaaagaaacauuggucacuuucaaaaauccccaugcgaagaaacaggauguuguuguuuuaggaucccaagaaggggccaugcauacagcacucacaggagcuacagaaauccaaaugucgucaggaaacuugcucuucacuggacaucucaagugcaggcugagaauggacaagcuacagcuuaaaggaaugucauacuccaugugcacaggaaaguucaaaguugugaaggaaauagcagaaacacaacauggaacgauagucaucagagugcaauaugaaggggacggcucuccauguaaaaucccauuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccaccgagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguaugggauggaaaucagaccauugaaagagaaagaagaaaaucugguuaacuccuuggucacagccggacaugggcagguugacaauuuuucacuaggaguccugggaauggcauuguuccuggaagaaaugcuuaggacccgaguaggaacgaaacaugcaauacuacuaguugcaguuucuuuugugacauugauuacagggaacauguccuucaaagaccuaggaagaguggugguuaugguaggcgcuacaauggcggaugacauagguaugggcgugaguuaucuugcccuacuagcagccuucaaaguuagaccaaccuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugguauuacaaaaugcauggaaagugaguugcacaauacuggcagugguguccguuuccccacugcucuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcagacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacacaggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucaaagcugagcacacugggcgggaaauuguggaucuaaugugucaugccacauuuaccaugaggcugcuaucaccaguuagagugccgaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagaccguuugguucguuccaagcauaaaagcaggaaaugauauagcagcuugccugagaaaaaauggaaagaaaguaauacaacucaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggacccaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuagcauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaauaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacuaacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacauuggagucccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauacccuaugauccaaaguuugaaaagcaguugggacaaguaaugcugcuaauccucugcgugacucaaguauuaaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccauuccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguggaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaucacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaguuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaacuaaucagacagauggaaggagaaggagucuuuaaaaacauccagaaccugacagucacagaagaaguugccgugcaaaacugguuggcaagaguggggcgcgaaagguugucaagaauggccaucaguggagaugauuguguugugaaaccuuuagaugacagguucgcaaacgcucugacagcccuaaaugacaugggaaagauuagaaaagauauacaacaaugggaaccuucaaaaggauggaaugauuggacacaagugccuuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucggacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6929 - RNA, 9876 nt, Artificial Sequence
  derived and/or modified CDS sequence (wt) from DENV-2__EU482650__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcugcagcuuaaaggaaugucauacuccaugugcacaggaaaguuuaaaguugugaaggaaauagcagaaacacaacauggaacgauagucaucagagugcaauaugaaggggacggcuccccaugcaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucaucaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuagucgcaguuucuuuugugacauugaucacagggaacauguccuucaaagaccuaggaagaguggugguuaugguaggugcuacaauggcggaugacauagguaugggcgugacuuaucuugcccuacuagcagccuuuaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaaugguaagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaccuaauaucauauggaggaggcuggaagcuagaaggagaauggaaggaaggagaagaaguccaggugcuggcacuggagccuggaaaaaauccaagagccguccaaacaaaaccaggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuucgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugacauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccgucugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguucuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcagcugggacaaguaaugcuacuaauccucugcgugacucaaguauugaugaugaggacuacaugggcucugugugaggccuuaaccuuagcuacagggcccaucuccacacugugggaaggaaauccaggaaaguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacacacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguuuguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguuaugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguucuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgagagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaucaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6930 - RNA, 9876 nt, Artificial Sequence
  derived and/or modified CDS sequence (wt) from DENV-2__EU482651__SS-prME
ucugcaggcaugaucauuaugcugauuccaacagugauggcguuccaucuaaccacacgcaacggagaaccacacaugaucgucgguauacaggagaaggggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacucuaaggaaguacugcauagaagcaaagcuaaccaacacaacaacagaaucccguugcccaacacaaggggaacccagccuaaaagaagagcaggauaagagguucgucuguaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauuaacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucgaauuggauacagaaagaaacauuggucacuuucaaaaauccccaugcgaagaaacaggauguuguuguuuuaggaucccaagaaggggccaugcauacagcacucacaggagcuacagaaauccaaaugucgucaggaaacuugcucuucacuggacaucucaagugcaggcugagaauggacaagcuacagcuuaaaggaaugucauacuccaugugcacaggaaaguucaaaguugugaaggaaauagcagaaacacaacauggaacgauagucaucagagugcaauaugaaggggacggcucuccauguaaaaucccauuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaagcucuaucggccaaauguuugagacaacgaugagaggggcgaagagaauggccauuuugggugacacagccugggacuuuggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaauauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaagauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauaacaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggaguccugggaauggcauuguuccuggaagaaaugcuuaggacccgaguaggaacgaaacaugcaauacuacuaguuacaguuucuuuugugacauugauuacagggaacauguccuucaaagaccuaggaagaguggugguuaugguaggcgcuacaauggcggaugacauagguaugggcgugacuuaucuugcccuacuagcagccuucaaaguuagaccaaccuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugguauuacaaaaugcauggaaagugaguugcacaauacuggcagugguguccguuuccccacugcuuuugacauccucacagcaaaaaacggauuggauaccauuagcauugacaaucaagggucucaacccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauacucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucaaagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagaccguuugguucguuccaagcauaaaagcaggaaaugauauagcagcuugccugagaaaaaauggaaagaaaguaauacaacucaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagacggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagaugcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaagcagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauacccuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccauuccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaucacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaauuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaacuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaaugauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacauuggguuccaacaagucggacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6931 - RNA, 9876 nt, Artificial Sequence
  derived and/or modified CDS sequence (wt) from DENV-2__EU482652__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaauuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauaguuuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccuugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucauuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauucgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaucaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaggugaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguucuuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaaugacggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaagugcuauaccagagaccgugcuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuagcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaacuaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagauuuaccagucugguuggcuuacaaaguggcagcugaaggcauuaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcggaaggggcauagggaagaugacccugggaaugugcugcauaaucacggcuagcacccuuuuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagccacagggcccaucuccacacugugggaaggaaauccaggaagguucuggaacacuaccauagcggugucaauggcuaacaucuuuagagggaguuacuuggcuggagcuggacuucucuuuuccauuaugaagaacacaaccaauacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacguacacucagaguccuuaauuuaguagaaaauugguugaacaacaacacucaauuuugcauaaaaguucucaauccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagagaagaagcuaggggaauucggcaaggcaaaaggcagcagagccauaugguacauguggcuuggagcucgcuuccuggaguuugaagcccuaggauuccuaaaugaagaccacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugaaaaacugguuggcaagaguggggcgcgaaaggcugucaagaauggccauuaguggagaugauuguguugugaaaccuuuagaugacagguucgcaaacgcuuugacagcccuaaaugacaugggaaagauuagaaaagauauacaacagugggaaccuucaaaaggauggaaugauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacgcagauuacaugccauccaugaaaagauucagaagagaggaggaagaagcaggaguccugugguaa

SEQ ID NO: 6932 - RNA, 9876 nt, Artificial Sequence
  derived and/or modified CDS sequence (wt) from DENV-2__EU482653__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaauaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcagucggaaaugacacaggaaaacacggcaaggaaaucaaagugacaccacagaguuccaucacagaagcagaauugaccgguuauggcaccgucacgauggagugcuccccgagaacaggccucgacuucaaugagaugguguuguugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguaucugggagucauggugcaggccgauagugguugcguugugagcuggaaaaacaaagaacugaaauguggcagugggauuuucgucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucucacaaccaaaccuuucucauugauggccccgagacggcagagugccccaacacaaauagagcuuggaacucguuggagguugaagacuacggcuuuggaguguucaccaccaauauauggcuaagauugaaagaaaaacaggaugcauucugcgacucaaaacucaugucggcggccauaaaagacaacagagccguccaugccgacauggguuacuggauagaaagugcacucaaugacacauggaagauagagaaagcuucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggaccuucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuggcagugacuaucauggcuaucuugugugucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaacgauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauuuuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuacaaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuagcaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaacugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagugggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacaaagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucgucacaccaaugcugagacauaguauugagaauuccucagugaauguaucccuaacagcaauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacgcaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaacugguugaacaacaacacucaauuuugcauaaaaguucucaacccauauaugcccucaguuauagaaaaaauggaagcacugcagaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccugaaugaagaucacugguucucuagagagaacucccugagcggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagcgggcaaguugguaccuauggacucaacacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguuugcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucagacuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaccagguuagaucucuuauaggcaaugaggaauacacagauuacaugccauccaugaaaagauucagaagagaagaggaagaagcaggaguccugugguaa

SEQ ID NO: 6933 - RNA, 9876 nt, Artificial Sequence
  derived and/or modified CDS sequence (wt) from DENV-2__EU482654__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauaguccuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacucuaugguagacagaggauggggaaauggauguggauuauuuggaaagggaggcaucgugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccaucacagaagcagaauugaccggguauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcugcagcuuaaaggaaugucauacuccaugugcacaggaaaguuuaaaguugugaaggaaauagcagaaacacaacauggaacgauagucaucagagugcaauaugaaggggacggcuccccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucaucaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaagaugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucuuauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggugcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagcuuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugacauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccgucugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacgcuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuuuaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaccuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacacacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguuuguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccauccccaugucaacauauggguggaaucuggugcgucuucagaguggaguugaugucuucuucaucccgccagaaaagugugacacauuguuaugugacauaggggagucaucaccaaaucccacaguggaagcaggacgaacacucagaguccuuaauuuaguagaaaacugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaacaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaagaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaccacugguucucuagagagaacucccugaguggaguggaaggagaagggcugcacaagcuagguuacauucuaagagacgugagcaagaaagagggaggagccauguacgccgacgacacagcaggaugggacacaagaaucacacuggaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgagagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaucaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6934 - RNA, 9876 nt, Artificial Sequence
  derived and/or modified CDS sequence (wt) from DENV-2__EU482656__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcgguaggaaaugacacaggaaaacacggcaaggaaaucaaagugacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaaacuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguucacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacugguacuggugggaauugugacacuguauuugggagucauggugcaggccgauagugguugcguugugagcuggaaaaacaaagaacugaaauguggcagugggauuuucgucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccacacacaaauagcaggaccauggcaccuagguaagcuugagauggacuuugauuucugcgauggaaccacagugauagugacugaggacugcggaaauagaggacccucuuugagaacaacuacugccucuggaaagcucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucucgcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugugucccaaacgcagugauauuacaaaaugcauggaaagugaguugcacaauacuggcagugguguccguuuccccauugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguagcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggauccccaaucaucgacaaaaaaggaaaaguugugggucuuuaugguaaugguguugucacaaggaguggagcauacgugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgagguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuauuauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucuuagaugaagaaagagaaaucccugaacguucauggaauucuggacaugagugggucacggauuuugaagggaagacuguuugguucguuccaagcauaaaagccggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuucuauucuugaugagcgggaggggcauagggaagaugacccugggaaugugcugcauaaucacggcuaguauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaaugagauggguuuccuagaaaaaacgaagaaggaucuuggauuaggaagcguugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgacggaauaacagugauugaucuagauccaauaccuuaugauccaaaguuugaaaaacaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacaccaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagagaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccauggcagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuuggggaauucggcaaggcaaaaggcagcagagccauaugguacauguggcuuggagcucgcuuccuggaguuugaagcccuaggauucuugaaugaagaucacugguucucuagagagaacucccugaguggaguggaaggagaagggcugcacaagcuagguuacauucuaagagacgugagcaagaaagagggaggagccauguaugccgacgacacagcaggaugggacacaagaaucacauuagaagaccuaaaaaaugaagaaaugguaacaaaccacauggaaggggaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcucugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaagaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6935 - RNA, 9876 nt, Artificial Sequence
  derived and/or modified CDS sequence (wt) from DENV-2__EU482657__SS-prME
ucugcaggcaugaucauuaugcugauuccaacagugauggcguuccaucuaaccacacgcaacggagaaccacacaugaucgucgguauacaggagaaagggaaaagucuacuguucaaaacagaggauggugugaacaugugcacccucauggccauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggaucaugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaaccuagccuaaaagaagagcaggacaagagguucgucugcaaacacuccaugguagacagaggauggggaaauggauguggauuauuuggaaagggaggcauugugaccugugcuauguucacauguaaaaagaacauggaagggaaaaucgugcagccagaaaacuuggaauacaccauugugguaacaccucacucaggggaggagcacgcggucggaaaugacacaggaaaacacggcaaggaaaucaaaguaacaccacagaguuccaucacagaagcagaauugacagguuaugguaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucagaggaaucaugcaggcaggaaaacgaucuuugcggccucagccuacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauggaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuggguaagcuugagauggacuuugauuucugcgauggaaccacagugauagugacugaggacugcggaaauagaggaccuucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccuuucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauacccuuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucgauaacgauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauugaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaacuaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaagguggugcuuugauggaauaaagaacaaccaaauccuggaagaaaauguggaaguugaaaucuggacaaaagaaggggaaaggaagaaacugaaacccagaugguuggaugcuaggaucuacucugacccacuggcgcuaaaagaguucaaagaauuugcagccggaagaaagucuuugacccugaaccuaaucacagaaauggguaggcuuccaacauucaugacucagaagacaagagacgcacuggauaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcacccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugaucgaucuagauccaauaccuuaugauccaaaguuugaaaagcagcugggacaaguaaugcuacuaauccucugcgugacucaaguauugaugaugaggacuacaugggcccugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuucuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaagcaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaggaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaauaagguggugcgugugcaaagaccaacaccaagaggcacaguaauggacaucauaucgagaagagaccaaagagguagugggcaaguugguaccuauggacucaauaccuucaccaauauggaagcccaauuaaucagacagauggagggagaaggagucuuuaaaaacauccagcaccugacagucacagaagaaguugccgugcauaacugguuggcaagaguggggcgcgaaagguuaucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguguacuuguugucccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6936 - RNA, 9876 nt, Artificial Sequence
  derived and/or modified CDS sequence (wt) from DENV-2__EU482658__SS-prME
ucggcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagccgucgcuccuucaaugacaaugcguugcauaggaauaucaaauagagacuuuguagaagggguuucaggaggaaguuggguugacauagucuuagaacauggaagcugugugacgacgauggcaaaaaacaaaccaacgcuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuauuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccauguguacaggaaaguuuaaaguugugaaggaaauagcagaaacacaacauggaacgauagucaucagagugcaauaugaaggggacggcucuccaugcaaaaucccuuuugagauaauggauuuggaaaaaagauaugucuuaggccgccugaucacagucaacccaauugugacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcgaagagaauggccauuuugggugacacagccugggacuuuggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauaacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacgacagagugcccuaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugcugacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacacgaguaggaacgaaacaugcaauacuacuaguuacaguuucuuuugugacauugaucacagggaacauguccuucaaagaccuaggaagagugguggucaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagcuuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagauuuaauaucauauggaggaggcuggaagcuagaaggagaauggaaggaaggagaagaaguccagguguuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuacgguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagcuaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagcuacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagccgaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggauuuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuacguuguaauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccguugauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaagaacguaagagaagugaaaggccuaacaaaaggaggaccaggacacgaagaacccaucccuaugucaacauauggguggaaucuggugcgucuucagaguggaguugacgucuuuuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguaguuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcacuagagaagaauucacaagaaaggugagaagcaaugcagccuugggggccauauucaccgaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccuggucuauacacgccaaacaugaauggaugacaacggaagacauguugacagucuggaacaggguguggauucgagauaacccauggauggaagacaaaaccccaguggaaucaugggaggaaaucccauacuugggaaaaagagaagaccaauggugcggcucauugauuggguuaacaaguagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6937 - RNA, 9876 nt, Artificial Sequence
  derived and/or modified CDS sequence (wt) from DENV-2__EU482659__SS-prME
ucggcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucuuaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucacuauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacgcuggauuucgaacugauaaaaacggaagccaaacagccugccacccuaagaaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggaguguuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaagcucuauuggccaaauguuugagacaacgaugagaggggcgaagagaauggccauuuugggugacacagccugggacuuuggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacgacagagugcccuaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugcugacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuucuggaggaaaugcucaggacacgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccagguguuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacagggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagcuacucccccgggaaguagagauccauuuccucagagcaaugcaccaaucauagaugaagaaagagaaaucccugaacguucauggaauacuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguauguuaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggauuuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcucaucccagaaccagaaaaacagagaacaccccaagacaaccaauugaccuacguuguaauagccauccucacagugguggccgcaaccauggcaaacgagauggguuuccuagaaaaaacgaaaaaggaucuuggauuaggaagcauugcaacccagcaacccgagagcaacauccuggacauagaccuacgucccgcaucagcuuggacgcuguaugccguggcuacaacauucgucacaccaaugcugagacauagcauugagaauuccucagugaauguaucccuaacagcuauagcuaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccguugauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuuuuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaacauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguaguuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaggaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuaggcuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggaguuuuuaaaaacauccagcaccugacagucacagaagaaguugccgugcaaaacugguuggcaagaguggggcgcgaaagguugucaagaauggccaucaguggagaugauuguguugugaaaccuuuagaugacagguuugcaaacgcuuugacagcccuaaaugacaugggaaagauuagaaaagauauacaacaaugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaacuuggucuauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcgaugaggaauacacagauuacaugccauccaugaaaagauucagaagagaagaggaagaagcaggaguccugugguaa

SEQ ID NO: 6938 - RNA, 9876 nt, Artificial Sequence
  derived and/or modified CDS sequence (wt) from DENV-2__EU482661__SS-prME
ucugcaggcaugaucauuaugcugauuccaacagugauggcguuucaucuaaccacacgcaacggagaaccacacaugaucgucgguauacaggagaaagggaaaagucuucuguucaaaacagaggauggugugaacaugugcacccuuauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcacacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcggaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaaugugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauuuuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaagaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacacuaccaccccuaagauacagaggugaggaugggugcugguacgggauggaaaucagaccauugaaagagaaagaagaaaaucugguuaacuccuuggucacagccggacaugggcagguugacaauuuuucacugggaguuuugggaauggcauuguucuuggaggaaaugcuuaggacccgaguaggaacgaaacaugcaauacuacuaguugcaguuucuuuugugacauugaucacaggaaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagcuauuuuucuaacaacccucucaagaaccaacaagaaaagaagcuggccacuaaaugaggcuaucauggcagucggaauggugagcauucuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggugcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaauuaucgacaaaaaaggaaaaguugugggucuuuaugguaaugguguugucacaaggaguggagcauauguaagugcuauagcccaaacugaaaaaagcauugaagacaaccccgagaucgaaggugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagaguaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaagccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaucguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucgucacaccaaugcugagacauagcauugagaauuccucagugaauguaucccuaacagcuauagccaaccaagcaacaguguuaaugggucuagggaaaggauggccacugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugugugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacgaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguagucaggcugcugacaaaaccuugggacguccuccccacgguaacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuaggcuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuuuuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaaugguguggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6939 - RNA, 9876 nt, Artificial Sequence
  derived and/or modified CDS sequence (wt) from DENV-2__EU482662__SS-prME
acagcaggcgugauuauuauguugauuccaacagcgauggcguuccaucuaaccacacguaauggagaaccacacaugaucguugguagacaagagaaagggaaaagucuucuguucaaaacggaggauggugugaacauguguacccucauggccauagaucuuggugaauugugugaagauacaaucacguacaagugcccccuccucaggcagaaugaaccagaagacauagauuguugguguaacuccacguccacauggguaacuuaugggacgugcaccaccacaggagaacacagaagagaaaaaagaucaguggcacucguuccacauguggguaugggacuggagacacgaacugaaacauggaugucgucagaaggagccuggaaacacgcucagagaauugaaaccuggaucuugagacauccaggcuuuaccauaauggcagcaauccuggcauacaccauaggaacgacacauuuccaaaaggcccugauuuucaucuuacugacagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacagaagccaaacaaccugccacuuuaaggaaguacuguauagaagcaaagcugaccaacacaacaacagaaucucguugcccaacacaaggggaacccagucuaaaugaagagcaggacaaaagguucgucugcaaacacuccaugguggacagaggauggggaaauggauguggauuauuuggaaagggaggcaucgugaccugugcuauguuuacaugcaaaaagaacauggaaggaaaaaucgugcagccggaaaauuuggaauacaccaucgugauaacaccccacucaggagaagagcaugcuguagguaaugacacaggaaaacaugguaaggaaaucaaaauaacaccacagaguuccaucacagaagcagaacugacaggcuauggcacaguuacgauggagugcucuccgagaacgggccuugacuuuaaugagauggugcugcugcagauggaagacaaagcuuggcuggugcacaggcagugguuccuagaccugccguuaccauggcuacccggagcggacacacaaggaucaaauuggauacagaaagagacacuggucaccuucaaaaauccucacgcgaagaaacaggaugucguuguuuuaggaucucaagaaggggccaugcacacggcacucacaggggccacagagauccagaugucaucaggaaacuuacuauucacaggacaucucaagugcaggcugagaauggacaaacuacagcucaaaggaaugucguacucuaugugcacaggaaaguucaaaauugugaaggaaauagcagaaacacaacauggaacaauaguuauuagaguacaauaugaaggagacggcucuccauguaagaucccuuuugaaauaauggauuuagaaaaaagacauguuuuaggucgccugauuacaguuaacccgaucguaacagaaaaagauagcccagucaacauagaagcagaaccuccauucggagacagcuacaucauuauaggaguagagccgggacaauugaaacucaacugguuuaagaaaggaaguuccauuggccaaauguuugagacaacaaugagaggagcgaagaggauggccaucuuaggugacacagccugggauuuuggaucccuaggaggaguguuuacaucuauaggaaaagcucuccaccaaguuuucggagcaaucuauggggcugccuuuaguggggucucauggacuaugaaaauccucauaggagccaucaucacauggauaggaaugaauucacguagcaccucacugucugugucacuaguauuggugggagucauaacacuguacuugggagccauggugcaggcugauagugguugcguugugagcuggaaaaacaaagaacugaaauguggcagcgggaucuucaucacagauaacgugcacacauggacagagcaauacaaguuccaaccagaauccccuucaaaauuagcuucagcuauccagaaagcucaugaagagggcauuugugggauucguucaguaacaagauuggagaaucugauguggaaacaaauaacaccagaauugaaccacauucuaucagaaaaugagguaaaguugaccaucaugacaggagauauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuauggcuuuggaguuuucaccaccaacauauggcuaaaauugagagaaaaacaggauguguuuugugacucaaaacucaugucagcagccauaaaagacaacagagccguccaugccgauauggguuacuggauagaaagugcacucaaugacacauggaagauggaaaaggccuccuucauugaaguuaaaagcugccacuggccaaagucacacacccucuggagcaauggaguauuagaaagugagaugauaauuccaaaaaguuuugcugggccagugucacaacacaacuacagaccaggcuauuacacgcaaacagcaggaccuuggcaucuagguaagcucgaaauggacuuugauuucugcgaaggaacuacagugguggugacugaggacugcggaaauagaggacccucuuuaagaacgaccacugccucuggaaaacuuauaacagaauggugcugccgauccugcacauuaccaccucuaagauacagaggugaggauggaugcugguaugggauggaaaucagaccauuaaaagagaaagaagagaauuuggucaacuccuuggucacagcaggacaugggcagauugacaacuucucacuaggagucuugggaauggcacuauucuuggaagaaaugcucaggacacgaguaggaacgaaacaugcaauacugcuaguugcaguuuccuuuaugacauugauuacugggaacauguccuuuagagaccugggaagagugaugguuauggugggcgcuaccaugacggaugacauagguaugggagugacuuaucuugcccuacuggcagcuuucaaaguuagaccaacuuuugcagcuggacuacuacugagaaagcugaccuccaaggaauuaaugauggcuaccauaggaauugcacuccuuucucaaagcaccauaccagagaccauucuugaacuaacugaugcguuagccuugggcaugaugguccuaaaaauagugagaaauauggaaaaguaccaauuggcagugacuaucauggcuaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccaucuuucuaacaacucuuucgagaaccagcaagaaaaggagcuggccacuaaaugaggcuaucauggcugucgggauggugagcauuuuagccaguucccucuuaaaaaaugacauucccaugacagguccauuaguggcuggagggcuccuuacugugugcuacgugcucacuggacgaucggccgauuuggaacuggagagagccaccgaugucaaaugggaagaucaggcagaaauaucaggaagcagcccaauccugucaauaacaauaucagaagauggcagcaugucgauaaagaaugaagaggaagaacaaacacugaccauacucaucagaacgggauugcuagugaucucaggacucuuuccagugucaauaccaauuacggcagcagcaugguaccugugggaagugaagaaacaacgggcuggaguauugugggacgucccuucacccccacccgugggaaaggcugaacuggaagauggagccuauagaaucaagcagaaagggauucuuggauacucccagauuggagccggaguuuacaaagaaggaacauuccauacaauguggcacgucacacguggcgcuguucugaugcauagagggaagaggauugaaccaucaugggcggacgucaagaaagaccuaauaucauauggaggaggcuggaaacucgaaggagaauggaaggaaggagaggaaguccaaguccuggcauuggaaccuggaaaaaauccaagagcuguucaaacgaaaccuggacuuuucaaaaccaacaccggaaccauaggcgccguaucucuggacuuuucuccuggaacgucaggauccccaauugucgacagaaaaggaaaaguugugggucuuuauggcaaugguguugucacaaggaguggagcauacgugagugcuauagcccagaccgaaaaaagcauugaagacaauccagagauugaagaugacauuuuccgaaagaaaagauugacuaucauggaccuccauccaggagcgggaaagacaaaaagauaccuuccagccauaguuagagaggccauaaaacguggcuuaagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacguuuacuaugaggcugcuaucaccagucagagugccaaauuacaaccugaucaucauggaugaagcucacuucacagacccagcaagcauagcagcuagaggauacauuucaacucgaguagagaugggugaagcagcugggauuuucaugacagccacuccuccgggaaguagagacccauuuccucagagcaaugcaccaaucauagaugaggaaagagaaaucccugagcguucguggaacucuggacaugaaugggucacggauuuuaaagggaagacuguuugguuuguuccaaguauaaaagcgggaaaugacauagcagcuugucucaggaaaaauggaaagaaagugauacaacucagcaggaagaccuuugacucugaguauguuaagacuaggaccaaugauugggacuuuguggucacaaccgacauuucagaaaugggugcuaacuucaaggcugagaggguuauagaccccagacguugcaugaaaccaguuauacuaacagauggugaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcgcauuggaaagaagcuaaaaugcuccuagauaacaucaacacaccugaaggaaucauuccuaguauguucgaaccagagcgugaaaagguggaugccauugauggugaauaccgcuugagaggagaagcaaggaaaaccuuuguggaccuaaugagaagaggggacuuaccagucuggcuggccuacagaguggcagcugaaggcaucaacuacgcagacagaaggugguguuuugauggaguuaagaauaaccaaauacuggaagaaaacguggaaguggaaauuuggacaaaagagggggaaaggaagaaauuaaaacccagaugguuggacgcuaggaucuauucugacccacuggcacuaaaagaauucaaggaauuugcagcuggaagaaagucccuaacccugaaccuaaucacagaaauggguaggcuuccaacuuucaugacucaaaaagcaagagaugcacuggauaaccuagcugugcugcauacggcugaggcagguggaagagcguacaaucaugcucucagugaacugccggagacccuggagacacugcuuuuacugacacuucuggcuacagucacgggaggaaucuucuuauucuuaaugagcggaaaagguguagggaagaugacccugggaaugugcugcauaaucacggcuagcauccuccuaugguaugcacagauacaaccacacuggauagccgcuucaauaauauuggaguuuuuucucauaguuuugcucauuccagaaccagaaaaacagagaacaccccaagauaaccaauugaccuacguugucauagccauccucacaguaguggccgcaaccauggcaaacgaaauggguuuucuggaaaaaaccaagaaagaccucggacugggaagcauugcaacucaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuccuugccauuggauguuacucacaagucaaccccauaacucucacagcagcucuucuuuuauugauagcacauuaugccauuauagggccaggacuucaagcgaaagcaaccagagaagcucagaaaagagcagcagcaggcaucaugaaaaacccaacagucgauggaauaacagugaucgaccuagauccaauacccuaugauccaaaauuugaaaaacaguuaggacaaguaaugcuccuaauucucugcgugacucaaguauuaaugaugaggacuacaugggcucugugugaggcucuaaccuuagcgaccgggcccaucuccacauugugggaaggcaauccagggagguuuuggaacacuaccauugcagugucaauggcuaacauuuuuagagggagcuacuuggcuggagcuggacuucuuuuuuccaucaugaagaauacaacaaauacaagaagaggaacuggcaacauaggagagacgcuuggagagaaauggaaaagccgauugaacgcacugggaaaaagugaauuucagauuuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugugguagagggggcuggucauacuauugugggggacuaaagaauguaagagaagucaaaggccugacaaaaggaggaccaggacacgaggaaccuauccccaugucaacauauggguggaaucuaguacgucugcagaguggaguugauguuuucuucacuccgccagaaaagugugacacacuguugugugacauaggggagucgucaccaaaucccacgauagaagcaggacgaacacucagaguccucagcuugguggaaaauugguugaacaaugacacucaauuuugcauaaagguucucaacccauacaugcccucaguuauagaaaaaauggaaacacugcagaggaaauauggaggagccuuagugaggaauccacucucacgaaacuccacacaugagauguacuggguauccaaugcuacuggaaacauagugucaucagugaacaugauuucaaggaugcugauuaacagauucacaaugaaacacaagaaagccaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauauaaaacaugggcuuaccauggcagcuaugaaacaaaacagacuggaucagcaucauccauggugaacggaguggucagacuacugacaaaaccuugggacgucgucccuaugguaacacagauggcaaugacagauacgaccccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggagccauauucacugaugagaacaaauggaagucggcacgcgaggcuguugaagauaguagguuuugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuucuuggaguuugaagcccugggauucuugaaugaagaucacugguucucuagagagaacucccugaguggaguggaaggagaagggcugcacaagcuaggcuacauucuaagagacgugagcaagaaggaaggaggagcaauguacgcugaugauacagcaggaugggacacaagaaucacacuagaggacuuaaaaaaugaagaaauggugacaaaccacauggaaggagaacacaagagacuagccgaggccauauuuaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaauuuucaaaagcauucagcaccugacagucacagaagaaaucgcuguacagaacugguuggcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucaaaaggauggaacgauuggacacaagugccuuucuguucacaccauuuucaugaguuaaucaugaaagacggccgcgugcuugugguuccaugcagaaaccaagaugaacugauuggcagggcccgaauuucucagggagcuggguggucuuugaaggagacugccuguuuggggaagucuuacgcccaaauguggagccugauguacuuccacagacgugaccucaggcuggcggcaaaugcuauuugcucggcagucccgucacauuggguuccuacaagucgaacaaccuggucuauacacgccaaacaugaauggaugacgacggaagacaugcugacagucuggaacaggguguggauccaagaaaacccauggauggaagacaaaacuccaguggagucaugggaggaagucccauauuugggaaaaagagaagaccaauggugcggcucauugauugggcuaacaagcagggcuaccugggcaaagaacauccaaacagcaauaaaucaagucagaucccuuauaggcaaugaagaauacacagauuacaugccauccaugaagagauucagaagggaagaggaagaggcagguguccugugguag

SEQ ID NO: 6940 - RNA, 9876 nt, Artificial Sequence
  derived and/or modified CDS sequence (wt) from DENV-2__EU482663__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaacugugugaagacacaaucacguacaaguguccucuucucaggcagaaugagccagaagacauagacuguuggugcaacuccacguccacguggguaaccuaugggaccuguaccacuacgggagagcauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuucguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaauuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccuaccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaccacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggauguauucugcgacucaaaacucaugucggcggccauaaaagacaacagagccguccaugccgacauggguuacuggauagaaagugcacucaaugacacauggaagauagagaaagccuccuucaucgagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaucuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuucuccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguagcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggaaccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuauggcaaugguguugucacaaggaguggagcauaugugagugcuauagcccaaacugaaaaaagcauugaagacaaccccgagaucgaagaugacauuuuccgaaagagaagacugaccaucauggaucuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccauuagagcugagcacacugggcgggaaauuguggaucuaaugugucaugccacauuuaccaugaggcugcuaucaccaguuagagugccaaacuauaacuugauuauuauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuagcauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucuuugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggagggguauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggauuuuggauuaggaagcauugcaacccagcaacccgagagcaacauccuggauauagaccuacgucccgcaucagcuuggacgcuguaugccguggcuacaacauuuguuacaccaaugcugagacauagcauugagaauuccucagugaauguaucccuaacagcuauagccaaucaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccauuuccacacugugggaaggaaauccaggaagguucuggaacacuaccauugcagugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaagaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuaugagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaauggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacugaugaaaaucacagcagaguggcuguggaaagaauuagggaagaaaaagacaccuaggaugugcaccagagaagaauucacaagaaaagugagaagcaaugcagccuugggggccauauucacugaugagaacaaguggaagucggcacgugaggcuguugaagauaguagguuuugggaguugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaacgaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaguuaaucagacagauggagggagaaggagucuuuaaaaacauccagcaccugacagucacagaagaaguugccgugcaaaacugguuggcaagaguggggcgcgaaagguugucaagaauggccaucaguggagaugacuguguugugaaaccuuuagaugacagguucgcaaacgcuuugacagcccuaaaugacaugggaaagauuagaaaagauauacagcagugggaaccuucaaaaggauggaacgauuggacacaagugcccuucuguucacaccauuuccaugagcuaaucaugaaggauggucguguacuuguuguuccauguagaaaccaagaugaacugaucggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagucccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacauagauuacaugccauccaugaaaagauucagaagagaagaggaagaagcaggaguccugugguaa

SEQ ID NO: 6941 - RNA, 9876 nt, Artificial Sequence
  derived and/or modified CDS sequence (wt) from DENV-2__EU482664__SS-prME
acagcaggcgugauuauuauguugauuccaacagcgauggcguuccaucuuaccacacgcaauggagaaccacacaugaucguugguagacaagagaaagggaaaagucuucuguucaaaacggaggauggugugaacauguguacccucauggccauagaucuuggugaauugugugaagauacaaucacguacaagugcccccuccucaggcagaaugaaccagaagacauagauuguugguguaacuccacguccacauggguaacuuaugggacgugcaccaccacaggagaacacagaagagaaaaaagaucaguggcacucguuccacaugugggcaugggacuggagacacgaacugaaacauggaugucaucagaaggagccuggaaacacgcucagagaauugaaaccuggaucuugagacauccaggcuuuacuauaauggcagcaauccuggcauacaccauaggaacgacacauuuucaaagggcccugauuuucaucuuacugacagcugucgcuccuucaaugacaaugcguugcauaggaauaucaaauagagacuuuguagaggggguuucaggaggaagcuggguugacauaguuuuagaacauggaaguugugugacgacaauggcaaaaaacaaaccaacauuggauuuugaacugauaaaaacagaagccaaacaaccugccacuuuaaggaaguacuguauagaagcaaagcugaccaacacaacaacagaaucucguugcccaacacaaggggaacccagucuaaaugaagagcaggacaaaagguucgucugcaaacacuccaugguggacagaggauggggaaauggauguggauuauuuggaaagggaggcaucgugaccugugcuauguuuacaugcaaaaagaacauggaaggaaaaaucgugcaaccagaaaauuuggaauacaccaucgugauaacaccucacucaggagaagagcaugcuguagguaaugacacaggaaaacaugguaaggaaaucaaaauaacaccacagaguuccaucacagaagcagaacugacaggcuauggcacaguuacgauggagugcucuccgagaacgggccuagacuuuaaugagauggugcugcugcagauggaagacaaagcuuggcuggugcacaggcagugguuccuagaccugccguuaccauggcuacccggagcggacacacaaggaucaaauuggauacagaaagagacacuggucacuuucaaaaauccccacgcgaagaaacaggaugucguuguuuuaggaucccaagaaggggccaugcacacggcacucacaggggccacagaaauccagaugucaucaggaaacuuacuauucacaggacaucucaagugcaggcugagaauggacaaacuacagcuuaaaggaaugucauacucuaugugcacaggaaaguuuaaaauugugaaggaaauagcagaaacacaacauggaacaauaguuauuagaguacaauaugaaggagacggcucuccauguaagaucccuuuugaaauaauggauuuagaaaaaagacaugucuuaggucgccugauuacaguuaacccgaucguaacagaaaaagauagcccagucaacauagaagcagaaccuccauucggagacagcuacaucauuauaggaguagagccgggacaauugaaacucaacugguuuaagaaaggaaguuccauuggccaaauguuugagacaacaaugagaggagcgaagaggauggccauuuuaggugacacagccugggauuuuggaucccuaggaggaguguuuacaucuauaggaaaagcucuccaccaaguuuucggagcaaucuauggggcugccuuuaguggggucucauggacuaugaaaauccucauaggagccaucaucacauggauaggaaugaauucacguagcaccucacugucugugucacuaguauuggugggagucauaacacuguacuugggagccauggugcaggcugauagugguugcguugugagcuggaaaaacaaagaacugaaauguggcagcggaaucuucaucacagauaacgugcacacauggacagaacaauacaaguuccaaccagaauccccuucaaaauuagcuucagcuauccagaaagcucaugaagagggcauuuguggaauucgcucaguaacaagauuggagaaucugauguggaaacaaauaacaccagaauugaaccacauucuaucagaaaaugagguaaaguugaccaucaugacaggagacauuaaaggaaucaugcaggcaggaaaacgaucccugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuauggcuuuggaguuuucaccaccaacauauggcuaaaauugagagaaaaacaggauguguucugugacucaaaacucaugucagcagccauaaaagacaacagagccguccaugccgauauggguuacuggauagaaagcgcacucaaugacacauggaagauggaaaaggccuccuucauugaaguuaaaagcugccacuggccaaagucacacacccucuggagcaauggaguauuagaaagugagaugauaauuccaaaaaguuuugcugggccagugucacaacacaacuacagaccaggcuauuacacgcaaacagcaggaccuuggcaucuagguaagcuugaaauggacuuugauuucugcgaaggaacuacagugguggugacugaggacugcggaaauagaggacccucuuuaagaacgaccacugccucuggaaaacucauaacagaauggugcugccgauccugcacauuaccaccucuaagauauagaggugaggauggaugcugguaugggauggaaaucagaccauuaaaagagaaagaagagaauuuggucaacuccuuggucacagcaggacaugggcagauugacaacuucucacuaggagucuugggaauggcacuauucuuggaagaaaugcucaggacacgaguaggaacgaaacaugcaauacugcuaguugcaguuuccuuugugacauugauuacugggaacauguccuuuagagaccugggaagagugaugguuauggugggcgcuaccaugacggaugacauaggcaugggagugacuuaucuugcccuacuagcagcuuucaaaguuagaccaacuuuugcagcuggacuacuacugagaaagcugaccuccaaggaauuaaugauggcuaccauaggaauugcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccacugcuuuuaacauccucacagcagaaagcggauuggauaccacuggcauugacgauaaaaggucucaauccaacagccauuuuucuaacaacucuuucgagaaccagcaagaaaaggagcuggccgcuaaaugaggcuaucauggcugucgggauggugagcauuuuagccaguucucucuuaaagaaugacauucccaugacagguccauuaguggcuggagggcuccuuacugugugcuacgugcucacuggacgaucggccgauuuggaacuggagagagccaccgaugucaaaugggaagaucaggcagaaauaucaggaagcagcccaauccugucaauaacaauaucagaagauggcagcaugucgauaaagaaugaagaggaagaacaaacacugaccauacucaucagaacgggauugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagccggaguuuacaaagaaggaacauuccauacaauguggcacgucacacguggcgcuguucugaugcauagagggaagaggauugaaccaucaugggcggacgucaagaaagaccuaauaucauauggaggaggcuggaaacucgaaggagaauggaaggaaggagaggaaguccaagucuuggcauuggaaccuggaaaaaauccaagagcuguccaaacgaaaccuggacuuuucaaaaccaacaccggaaccauaggcgccguaucucuggacuuuucuccuggaacgucaggaucuccaauugucgacagaaaaggaaaaguugugggucuuuauggcaaugguguugucacaaggaguggagcauacgugagugcuauagcccagaccgaaaaaagcauugaagacaauccagagauugaagaugacauuuuccgaaagaaaagauugaccaucauggaccuccauccaggagcgggaaagacaaaaagauaccuuccagccauaguuagagaggccauaaaacguggcuuaagaacauuaauccuggcccccacuagagucguggcagcugaaauggaggaagcucuuagaggacuuccaauaagauaccaaaccccagccaucagagccgagcauaccgggcgggagauuguggaccuaaugugucaugccacguuuacuaugaggcugcuaucaccagucagagugccaaacuacaaccugaucaucauggaugaagcucacuucacagacccagcaaguauagcagcuagaggauacauuucaacucgaguagagaugggagaagcagcugggauuuucaugacagcuacuccuccgggaaguagagacccauuuccucagagcaaugcaccaaucauagaugaggaaagagaaaucccugagcgcucguggaacucuggacaugaaugggucacggauuuuaaagggaagacuguuugguuuguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacguugcaugaaaccaguuauacuaacagauggugaagagcgggugaucuuggcaggacccaugccaguaacccacucuagugcagcacaaagaagagggagaauaggaagaaauccaaaaaaugaaaaugaccaguacauauacaugggggaaccucuggaaaaugaugaagacugugcgcauuggaaagaagcuaaaaugcuccuagauaacaucaacacaccugaaggaauuauuccuaguauguucgaaccagagcgugaaaagguggaugccauugauggugaauaccgcuugagaggagaagcaaggaaaaccuuuguggaccuaaugagaagaggggacuuaccagucuggcuggccuacagaguggcagcugaaggcaucaacuacgcagacagaaggugguguuuugauggaguuaagaacaaccaaauacuggaagaaaacguggaaguggaaauuuggacaaaagaaggggaaaggaagaaauuaaaacccagaugguuggacgcuaggaucuauucugacccacuggcacuaaaagaauucaaggaauuugcagcuggaagaaagucccuaacccugaaccuaaucacagaaauggguaggcuuccaacuuucaugacucaaaaagcaagagacgcacuggauaaccuagcugugcugcacacggcugaggcggguggaagagcguacaaucaugcucucagugaacugccggagacccuggagacacugcuuuuacugacacuucuggcuacagucacgggaggaaucuucuuauucuuaaugagcggaaaagguguagggaagaugacccugggaaugugcugcauaaucacggcuagcauccuccuaugguaugcacagauacaaccacacuggauagccgcuucaauaauauuggaauuuuuucucauaguuuugcucauuccagaaccagaaaaacagagaacaccccaagauaaccaauugacuuacguugucauagccauccucacaguaguggccgcaaccauggcaaacgaaauggguuuucuggaaaaaaccaagaaagaccucggauugggaagcguugcaacccaggaaccugagagcaacauucuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuccuugccauuggauguuacucacaagucaaccccauaacucucacagcagcucuucuuuuauugauagcacauuaugccauuauagggccaggacuucaagcgaaagcaaccagagaagcucagaaaagagcagcagcaggcauaaugaaaaacccaacagucgauggaauaacagugaucgaccuagauccaauacccuaugauccaaaauuugaaaagcaguugggacaaguaaugcuccuaauucucugcgugacucaaguauuaaugaugaggacuacaugggcucugugugaggcucuaaccuuagcgaccgggcccaucuccacauugugggaaggcaauccagggagguuuuggaacacaaccauugcagugucaauggcuaacauuuuuagagggagcuacuuggcuggagcuggacuucuuuuuuccaucaugaagaauacaacaaauacaagaagaggaacuggcaacauaggagagacgcuuggagagaaauggaaaagccgauugaacgcacugggaaaaagugaauuucagauuuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacuaaagaauguaagagaagucaaaggccugacaaaaggaggaccaggacacgaggaaccuauccccaugucaacauauggguggaaucuaguacgucugcagaguggaguugauguuuucuucacuccgccagaaaagugugacacacuguugugugacauaggggagucgucaccaaaucccacgauagaagcaggacgaacacucagaguccugagcuugguggaaaauugguugaacaaugacacccaauuuugcauaaagguucucaauccauacaugcccucaguuauagaaaaaauggaaacacugcaaaggaaauauggaggagccuuagugaggaauccacucucacgaaacuccacacaugagauguacuggguauccaaugcuacugggaacauagugucaucagugaacaugauuucaaggaugcugauuaacagauucacaaugaaacacaagaaagcuaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauauaaaacaugggcuuaccauggcagcuaugaaacaaaacagacuggaucagcaucauccauggugaacggaguggucagacuacugacaaaaccuugggacgucgucccuaugguaacacagauggcaaugacagauacgacuccauuuggacaacaacgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggggccauauucacugaugagaacaaauggaagucggcacgcgaggcuguugaagauaguagguuuugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuucuuggaguuugaagcccugggauucuugaaugaagaucacugguucucuagagagaacucccugaguggaguggaaggagaagggcugcacaagcuaggcuacauucuaagagacgugagcaagaaggaaggaggagcaauguacgccgaugauacagcaggaugggacacaagaaucacacuagaggacuuaaaaaaugaagaaauggugacaaaccacauggaaggagaacacaagagacuagccgaggccauauuuaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaauuuucaaaagcauucagcaccugacaguuacagaagaaaucgcuguacagaacugguuggcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaacccucaaaaggauggaacgauuggacacaagugccuuuuuguucacaccauuuucaugaguuaaucaugaaagacggccgugugcuuguggucccaugcagaaaccaagaugaacugauuggcagggcccgaauuucccagggagcuggguggucuuugaaggagacggccuguuuggggaagucuuacgcccaaauguggagccugauguacuuccacagacgugaccucaggcuggcggcaaaugcuauuugcucggcagucccgucacauuggguuccuacaagucgaacaaccuggucuauacacgccaaacacgaauggaugacgacggaagacaugcugacagucuggaacaggguguggauccaagaaaacccauggauggaagauaaaacuccaguggagucaugggaggaagucccauauuugggaaaaagagaagaccaauggugcggcucauugauugggcuaacaagcagggcuaccugggcaaagaauauccaaacagcaauaaaucaagucagaucccuuauaggcaaugaagaauacacagauuacaugccauccaugaagagauucagaagggaagaggaagaggcagguguccugugguag

SEQ ID NO: 6942 - RNA, 9876 nt, Artificial Sequence
  derived and/or modified CDS sequence (wt) from DENV-2__EU482665__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaacugugugaagacacaaucacguacaaguguccucuucucagacagaaugagccagaagacauagacuguuggugcaacuccacguccacguggguaaccuaugggaccuguaccacuacgggagagcauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaauuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaccacauucuagcagaaaaugaggugaaguugacuaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccuccuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaucuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacucgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuucuccacugcuuuugacauccucacagcaaaaaacggauuggauaccauuagcauugacaaucaagggucucaauccaacagccauuuuccuaacaacccucucaagaaccaacaagaaaagaagcuggccacuaaaugaggcuaucauggcagucggaauggugagcauuuuagccaguucccuccuaaaaaaugauauucccaugacaggaccacuaguagcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucuuuggacuuuuccccuggaacgucaggaucuccaaucaucgacaaaaaaggaaaaguugugggucuuuauggcaaugguguugucacaaggaguggagcauaugugagugcuauagcccaaacugaaaaaagcauugaagacaaccccgagaucgaagaugacauuuuccgaaagagaagacugaccauuauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccauuagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuagcauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucauugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggauuuuggauuaggaagcauugcaacccagcaacccgagagcaacauccuggauauagaccuacgucccgcaucagcuuggacgcuguaugccguggcuacaacauucguuacaccaaugcugagacauagcauugagaauuccucagugaauguaucccuaacagccauagccaaucaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccauuuccacacugugggaaggaaauccaggaagguucuggaacacuaccauugcagugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacugaugaaaaucacagcagaguggcuguggaaagaauuagggaagaaaaagacaccuaggaugugcaccagagaagaauucacaagaaaagugagaagcaaugcagccuugggggccauauucacugaugagaacaaguggaagucggcacgugaggcuguugaagauaguagguuuugggaguugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguucgaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaacgaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcucaauuaaucagacagauggagggagaaggagucuuuaaaaacauccagcaccugacagucacagaagaaguugccgugcaaaacugguuggcaagaguggggcgcgaaagauugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugaucggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6943 - RNA, 9876 nt, Artificial Sequence
  derived and/or modified CDS sequence (wt) from DENV-2__EU482666__SS-prME
acagcaggcgugauuauuauguugauuccaacagcgauggcguuccaucuaaccacacguaauggagaaccacacaugaucguugguagacaagagaaagggaaaagucuucuguucaaaacggaggauggugugaacauguguacccucauggccauagaucuuggugaauugugugaagauacaaucacguacaagugcccccuccucaggcagaaugaaccagaagacauagauuguugguguaacuccacguccacauggguaacuuaugggacgugcaccaccacaggagaacacagaagagaaaaaagaucaguggcacucgucccacauguggguaugggacuggagacacgaacugaaacauggaugucgucagaaggagccuggaaacacgcucagagaauugaaaccuggaucuugagacauccaggcuuuaccauaauggcagcaauccuggcauacaccauaggaacgacacauuuccaaagggcccugauuuucaucuuacugacagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacagaagccaaacaaccugccacuuuaaggaaguacuguauagaagcaaagcugaccaacacaacaacagaaucucguugcccaacacaaggggaacccagucuaaaugaagagcaggacaaaagguucgucugcaaacacuccaugguggacagaggauggggaaauggauguggauuauuuggaaagggaggcaucgugaccugugcuauguuuacaugcaaaaagaacauggaaggaaaaaucgugcagccggaaaauuuggaauacaccaucgugauaacaccucacucaggagaagagcaugcuguagguaaugacacaggaaaacaugguaaggaaaucaaaauaacaccacagaguuccaucacagaagcagaacugacaggcuauggcacaguuacgauggagugcucuccgagaacgggccuugacuuuaaugagauggugcugcugcagauggaagacaaagcuuggcuggugcacaggcagugguuccuagaccugccguuaccauggcuacccggagcggacacacaaggaucaaauuggauacagaaagagacacuggucaccuucaaaaauccucacgcgaagaaacaggaugucguuguuuuaggaucucaagaaggggccaugcacacggcacucacaggggccacagagauccagaugucaucaggaaacuuacuauucacaggacaucucaagugcaggcugagaauggacaaacuacagcucaaaggaaugucguacucuaugugcacaggaaaguucaaaauugugaaggaaauagcagaaacacaacauggaacaauaguuauuagaguacaauaugaaggagacggcucuccauguaagaucccuuuugaaauaauggauuuagaaaaaagacauguuuuaggucgccugauuacaguuaacccgaucguaacagaaaaagauagcccagucaacauagaagcagaaccuccauucggagacagcuacaucauuauaggaguagagccgggacaauugaaacucaacugguuuaagaaaggaaguuccauuggccaaauguuugagacaacaaugagaggagcgaagaggauggccaucuuaggugacacagccugggauuuuggaucccuaggaggaguguuuacaucuauaggaaaagcucuccaccaaguuuucggagcaaucuauggggcugccuuuaguggggucucauggaccaugaaaauccucauaggagccaucaucacauggauaggaaugaauucacguagcaccucacugucugugucacuaguauuggugggagucauaacacuguacuugggagccauggugcaggcugauagugguugcguugugagcuggaaaaacaaagaacugaaauguggcagcgggaucuucaucacagauaacgugcacacauggacagagcaauacaaguuccaaccagaauccccuucaaaauuagcuucagcuauccagaaagcucaugaagagggcauuugugggauucguucaguaacaagauuggagaaucugauguggaaacaaauaacaccagaauugaaccacauucuaucagaaaaugagguaaaguugaccaucaugacaggagauauuaaaggaaucaugcaggcaggaaaacgaucucugcggccccagcccacugagcugaaguauucauggaaaacauggggaaaggcgaaaaugcucuccacagaaucucauaaccagaccuuucucauugauggccccgaaacagcagaaugccccaacacaaacagagcuuggaacucgcuggaaguugaagacuauggcuuuggaguuuucaccaccaacauauggcuaaaauugagagaaaaacaggauguguuuugugacucaaaacucaugucagcagccauaaaagacaacagagccguccaugccgauauggguuacuggauagaaagugcacucaaugacacauggaagauggaaaaggccuccuucauugaaguuaaaagcugccacuggccaaagucacacacccucuggagcaauggaguauuagaaagugagaugauaauuccaaaaaguuuugcugggccagugucacaacacaacuacagaccaggcuaucacacgcaaacagcaggaccuuggcaucuagguaagcuugaaauggacuuugauuucugcgaaggaacuacagugguggugacugaggacugcggaaauagaggacccucuuuaagaacgaccacugccucuggaaaacuuauaacagaauggugcugccgauccugcacauuaccaccucuaagauacagaggugaggauggaugcugguaugggauggaaaucagaccauuaaaagagaaagaagagaauuuggucaacuccuuggucacagcaggacaugggcagauugacaacuucucacuaggagucuugggaauggcacuauucuuggaagaaaugcucaggacacgaguaggaacgaaacaugcaauacugcuaguugcaguuuccuuuaugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacuacugagaaagcugaccuccaaggaauuaaugauggcuaccauaggaauugcacuccuuucucaaagcaccauaccagagaccauucuugaacuaacugaugcguuagccuugggcaugaugguccuaaaaauaaugagaaauauggaaaaguaccaauuggcagugacuaucauggcuaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccaucuuucuaacaacucuuucgagaaccagcaagaaaaggagcuggccgcuaaaugaggcuaucauggcugucgggauggugagcauuuuagccaguucccucuuaaaaaaugacauucccaugacagguccauuaguggcuggagggcuccuuacugugugcuacgugcucacuggacgaucggccgauuuggaacuggagagagccaccgaugucaaaugggaagaucaggcagaaauaucaggaagcagcccaauccugucaauaacaauaucagaagauggcagcaugucgauaaagaaugaagaggaagaacaaacacugaccauacucaucagaacgggauugcuagugaucucaggacucuuuccagugucaauaccaauuacggcagcagcaugguaccugugggaagugaagaaacaacgggcuggaguauugugggacgucccuucacccccacccgugggaaaggcugaacuggaagauggagccuauagaaucaagcagaaagggauucuuggauacucccagauuggagccggaguuuacaaagaaggaacauuccauacaauguggcacgucacacguggcgcuguucugaugcauagagggaagaggauugaaccaucaugggcggacgucaagaaagaccuaauaucauauggaggaggcuggaaacucgaaggagaauggaaggaaggagaggaaguccaaguccuggcauuggaaccuggaaaaaauccaagagcuguucaaacgaaaccuggacuuuucaaaaccaacaccggaaccauaggcgccguaucucuggacuuuucuccuggaacgucaggauccccaauugucgacagaaaaggaaaaguugugggucuuuauggcaaugguguugucacaaggaguggagcauacgugagugcuauagcccagaccgaaaaaagcauugaagacaauccagagauugaagaugacauuuuccgaaagaaaagauugacuaucauggaccuccauccaggagcgggaaagacaaaaagauaccuuccagccauaguuagagaggccauaaaacguggcuuaagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacguuuacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccgggaaguagagacccauuuccucagagcaaugcaccaaucauagaugaggaaagagaaaucccugagcguucguggaacucuggacaugaaugggucacggauuuuaaagggaagacuguuugguuuguuccaaguauaaaagcgggaaaugacauagcagcuugucucaggaaaaauggaaagaaagugauacaacucagcaggaagaccuuugacucugaguauguuaagacuaggaccaaugauugggacuuuguggucacaaccgacauuucagaaaugggugcuaacuucaaggcugagaggguuauagaccccagacguugcaugaaaccaguuauacuaacagauggugaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcgcauuggaaagaagcuaaaaugcuccuagauaacaucaacacaccugaaggaaucauuccuaguauguucgaaccagagcgugaaaagguggaugccauugauggugaauaccgcuugagaggagaagcaaggaaaaccuuuguggaccuaaugagaagaggggacuuaccagucuggcuggccuacagaguggcagcugaaggcaucaacuacgcagacagaaggugguguuuugauggaguuaagaauaaccaaauacuggaagaaaacguggaaguggaaauuuggacaaaagagggggaaaggaagaaauuaaaacccagaugguuggacgcuaggaucuauucugacccacuggcacuaaaagaauucaaggaauuugcagcuggaagaaagucccuaacccugaaccuaaucacagaaauggguaggcuuccaacuuucaugacucaaaaagcaagagaugcacuggauaaccuagcugugcugcauacggcugaggcagguggaagagcguacaaucaugcucucagugaacugccggagacccuggagacacugcuuuuacugacacuucuggcuacagucacgggaggaaucuucuuauucuuaaugagcggaaaagguguggggaagaugacccugggaaugugcugcauaaucacggcuagcauccuccuaugguaugcacagauacaaccacacuggauagccgcuucaauaauauuggaguuuuuucucauaguuuugcucauuccagaaccagaaaaacagagaacaccccaagauaaccaauugaccuacguugucauagccauccucacaguaguggccgcaaccauggcaaacgaaauggguuuucuggaaaaaaccaagaaagaccucggacugggaagcauugcaacucaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuccuugccauuggauguuacucacaagucaaccccauaacucucacagcagcucuucuuuuauugauagcacauuaugccauuauagggccaggacuucaagcgaaagcaaccagagaagcucagaaaagagcagcagcaggcaucaugaaaaacccaacagucgauggaauaacagugaucgaccuagauccaauacccuaugauccaaaauuugaaaaacaguuaggacaaguaaugcuccuaauucucugcgugacucaaguauuaaugaugaggacuacaugggcucugugugaggcucuaaccuuagcgaccgggcccaucuccacauugugggaaggcaauccagggagguuuuggaacacuaccauugcagugucaauggcuaacauuuuuagagggagcuacuuggcuggagcuggacuucuuuuuuccaucaugaagaauacaacaaauacaagaagaggaacuggcaacauaggagagacgcuuggagagaaauggaaaagccgauugaacgcacugggaaaaagugaauuucagauuuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugugguagagggggcuggucauacuauugugggggacuaaagaauguaagagaagucaaaggccugacaaaaggaggaccaggacacgaggaaccuauccccaugucaacauauggguggaaucuaguacgucugcagaguggaguugauguuuucuucacuccgccagaaaagugugacacacuguugugugacauaggggagucgucaccaaaucccacgauagaagcaggacgaacacucagaguccucagcuugguggaaaauugguugaacaaugacacucaauuuugcauaaagguucucaacccauacaugcccucaguuauagaaaaaauggaaacacugcagaggaaauauggaggagccuuagugaggaauccacucucacgaaacuccacacaugagauguacuggguauccaaugcuacuggaaacauagugucaucagugaacaugauuucaaggaugcugauuaacagauucacaaugaaacacaagaaagccaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauauaaaacaugggcuuaccauggcagcuaugaaacaaaacagaccggaucagcaucauccauggugaacggaguggucagacuacugacaaaaccuugggacgucgucccuaugguaacacagauggcaaugacagauacgaccccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggagccauauucacugaugagaacaaauggaagucggcacgcgaggcuguugaagauagcagguuuugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuucuuggaguuugaagcccugggauucuugaaugaagaucacugguucucuagagagaacucccugaguggaguggaaggagaagggcugcacaagcuaggcuacauucuaagagacgugagcaagaaggaaggaggagcaauguacgccgaugauacagcaggaugggacacaagaaucacacuagaggacuuaaaaaaugaagaaauggugacaaaccacauggaaggagaacacaagagacuagccgaggccauauuuaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaauuuucaaaagcauucagcaccugacagucacagaagaaauugcuguacaaaacugguuggcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucaaaaggauggaacgauuggacacaagugccuuucuguucacaccauuuucaugaguuaaucaugaaagacggccgcgugcuugugguuccaugcagaaaccaagaugaacugauuggcagggcccgaauuucucagggagcuggguggucuuugaaggagacugccuguuuggggaagucuuacgcccaaauguggagccugauguacuuccacagacgugaccucaggcuggcggcaaaugcuauuugcucggcagucccgucacauuggguuccuacaagucgaacaaccuggucuauacacgccaaacaugaauggaugacgacggaagacaugcugacagucuggaacaggguguggauccaagaaaacccauggauggaagacaaaacuccaguggagucaugggaggaagucccauauuugggaaaaagagaagaccaauggugcggcucauugauugggcuaacaagcagggcuaccugggcaaagaacauccaaacagcaauaaaucaagucagaucccuuauaggcaaugaagaauacacagauuacaugccauccaugaagagauucagaagggaagaggaagaggcagguguccugugguag

SEQ ID NO: 6944 - RNA, 9876 nt, Artificial Sequence
  derived and/or modified CDS sequence (wt) from DENV-2__EU482667__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaacugugugaagacacaaucacguacaaguguccucuucucaggcagaaugagccagaagacauagacuguuggugcaacuccacguccacguggguaaccuaugggaccuguaccacuacgggagagcauaggagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaauuuagaauacaccauugugguaacaccucacucaggggaggagcaugcggucggaaaugacacaggaaaacacggcaaggaaaucaaaguaacaccacagaguuccaucacagaagcggaauugaccgguuaugguaccgucacgauggagugcuccccgagaacaggccucgacuucaaugagaugguguugcugcagauggaaaauaaagcuuggcuggugcauaggcaaugguuucuagaccuaccauuaccauggcugcccggagcggauaaacaagagucaaauuggauacagaaagaagcauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucaaagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaccacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggauguauucugcgacucaaaacucaugucggcggccauaaaagacaacagagccguccaugccgacauggguuacuggauagaaagugcacucaaugacacauggaagauagagaaagccuccuucauugagguaaaaaacugccacuggccaaaaucacacacccucuggaguaauggagugcuagaaagugagaugauaaucccaaagaaucucgcuggaccagugucucaacacaacuauagaccagguuaccauacacaaauagcaggaccauggcaucuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuucuccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguagcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuauggcaaugguguugucacaaggaguggagcauaugugagugcuauagcccaaacugaaaaaagcauugaagacaaccccgagaucgaagacgacauuuuccgaaagagaagacugaccaucauggaucuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccauuagagcugagcacacugggcgggaaauuguggaucuaaugugucaugccacauuuaccaugaggcuacuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuagcauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucuuugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggauuuuggauuaggaagcauugcaacccagcaacccgagagcaacauccuggauauagaccuacgucccgcaucagcuuggacgcuguaugccguggcuacaacauucguuacaccaaugcugagacauagcauugagaauuccucagugaauguaucccuaacagcuauagccaaucaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaggcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccauuuccacacugugggaaggaaauccaggaagguucuggaacacuaccauugcagugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacugaugaaaaucacagcagaguggcuguggaaagaauuagggaagaaaaagacaccuaggaugugcaccagagaagaauucacaagaaaagugagaagcaaugcagccuugggggccauauucacugaugagaacaaguggaagucggcacgugaggcuguugaagauaguagguuuugggaguugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagacuuaaaaaacgaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugaucggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucucauaggcaaugaggaauacacagauuacaugccauccaugaaaagauucagaagagaagaggaagaagcaggaguccugugguaa

SEQ ID NO: 6945 - RNA, 9876 nt, Artificial Sequence
  derived and/or modified CDS sequence (wt) from DENV-2__EU482668__SS-prME
ucugcaggcaugaucauuaugcugauuccaacaguaauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagagaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagagaacuuggaauacaccauugugguaacaccucacucaggggaggagcaugcggucggaaaugacacaggaaaacacggcauggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuccuagaccugccauuaccauggcugcccggagcggauaaacaagagucaaauuggauacagaaagaaacauugguuacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggaucuggaaaaaagauaugucuuaggccgccuaaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucaucaucacauggauaggaaugaacucacgcagcaccucacuaucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucgguaacaagauuggagaaccuaauguggaaacaaauaacaccagaauuaaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcgggaccauggcaccuagguaagcuugagauggacuuugauuucugcgauggaaccacagugauagugacugaggacugcggaaauagaggacccucuuugagaacgacuacugccucuggaaaacucauaacagaauggugcugccgaucuugcacauuaccaccccuaagauauagaggugaggaugggugcugguacgggauggaaaucagaccguugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauagguaugggcgugacuuaucuugcccuacuagccgccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcugcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggaaccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacggggucugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugaucaucauggacgaagcccauuucacagacccagcaaguauagcagcuagaggauacaucucaacccgaguggaaaugggugaagcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaggaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagaccuuagagacacugcuuuuacugacacuucuggccacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaacguaucccuaacagcuauagccaaccaagcaacaguguuaaugggucuagggaaaggauggccauugucaaagauggacaucggaguuccccuucucgccauuggauguuacucacaagucaauccuauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaagaaguggauaggaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacgucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccaaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaaaucggcacgugaggcuguugaagauaguagguuuugggagcugguugacaaggaaaggaaucuccaucuugaaggaaagugugaaacauguguguacaacaugaugggaaaaagagaaaagaagcuaggggaauucggcaaggcaaaaggcagcagagccauaugguacauguggcuuggagcucgcuuucuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaacacuuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguauacuuguuguuccauguagaaaccaagaugaacugauuggcagagcccgaaucucccaaggagcaggguggucucugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6946 - RNA, 9876 nt, Artificial Sequence
  derived and/or modified CDS sequence (wt) from DENV-2__EU482669__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccgcguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacucuaaggaaguacugcauagaagcaaagcuaaccaacacaacaacagaaucccguugcccaacacaaggggaacccagcuuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaaguagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucgaauuggauacagaaagaaacauuggucacuuucaaaaauccccaugcgaagaaacaggauguuguuguuuuaggaucccaagaaggagccaugcauacagcacucacaggagcuacagaaauccaaaugucaucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccauuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucuguaucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagaaggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaauugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaaccacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaagaaaugcuuaggacccgaguaggaacgaaacaugcaauacuacuaguugcaguuucuuuugugacauugauuacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacaucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucaaagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuauaaagggaagaccguuugguucguuccaagcauaaaagcaggaaaugauauagcagcuugccugagaaaaaaugggaagaaaguaauacaacucaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaagguggugcuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaaugggcaggcuuccaacauucaugacucagaagacaagagacgcacuggacaaccuagcagugcugcacacggcugaagcagguggaagagcguauaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaagguaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccauuccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucuggaaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaucacccauacaaaacgugggcauaccaugguagcuaugaaacaaaacagacuggaucagcaucauccauggucaacggaguggucaggcugcugacaaaaccuugggacguccuccccacggugacacagauggcgaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaauaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaauuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaacuaaucagacagauggagggagaaggagucuuuaaaaccauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucggacaaccugguccauacacgccaaacaugaauggaugacaacggaagacauguugacagucuggaauaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccuaugguaa

SEQ ID NO: 6947 - RNA, 9876 nt, Artificial Sequence
  derived and/or modified CDS sequence (wt) from DENV-2__EU482670__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaauuacguacaaguguccucuucucaggcagaaugagccagaagacauagacuguuggugcaacuccacguccacguggguaaccuaugggaccuguaccacuacgggagaacauagaagagaaaaaagaucaguggcacuuguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcgcugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucguacaaccagaaaacuuggaauacaccauugugguaacaccucacucaggggaggagcaugcggucggaaaugacacaggaaaacacggcaaggaaaucaaagugacaccacagaguuccaucacagaagcagaauugaccgguuauggcaccgucacgauggagugcuccccgagaacaggccucgacuucaaugagaugguguugcugcagauggaaaauaaagcuuggcuggugcauagacaaugguuucuagaccugccauuaccauggcugcccggagcggauaaacaagagucaaauuggauacagaaagaaacauuggucacuuucaaaaauccccaugcgaagaaacaagauguuguuguuuuaggaucccaagaaggggccaugcauacagcacucacaggagcuacagaaauccaaaugucgucaggaaacuugcucuucacuggacaucucaagugcagguugagaauggacaagcuacagcuuaaaggaaugucauacuccaugugcacaggaaaguuuaaagucaugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacauccauaggaaaagcucuccaccaagucuuuggagcaaucuauggagcugccuucagugggguaucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaauuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucucauaaccaaacuuuucucauugauggccccgagacggcagagugccccaacacaaauagagcuuggaacucguuggagguugaagacuacggcuuuggaguguucaccaccaauauauggcuaaaauugaaagaaaaacaggaugcauucugugacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggagcaauggagugcuagaaagugagaugauaaucccaaagaaucucgcuggaccagugucucaacacaacuauagaccaggcuaccauacacaaguagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccgucuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaggugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccauuagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuauucugacccacuggcgcuaaaagaguucaaagaauuugcagccggaagaaagucucugacccugaaccuaaucacagaaauggguaggcuuccaacauuuaugacucagaagacaagagacgcacuggacaaccuagcggugcugcacacggccgaagcagguggaagggcauacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagaaaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguuaaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcauuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcccgcuuccuggaguuugaagcccuaggauuccugaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaauaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguauacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6948 - RNA, 9876 nt, Artificial Sequence
  derived and/or modified CDS sequence (wt) from DENV-2__EU482671__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauaguuuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucaucugcaaacacuccaugguagacagaggauggggaaauggauguggacuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugagggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucauucauugagguaaaaaacugccacuggccaaagucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcugugucucuagacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauucccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaagguggaugccauugauggcgaauaccguuugagaggagaagcaaggaaaacauuuguggacuugaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcuguauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcacuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagagaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagacaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacagugauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugcugugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccaugcagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6949 - RNA, 9876 nt, Artificial Sequence
  derived and/or modified CDS sequence (wt) from DENV-2__EU482674__SS-prME
ucugcaggcaugaucauuaugcugauuccaacagugauggcguuucaucuaaccacacgcaacggagaaccacacaugaucgucaguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacacagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagccgucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaauugugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggaguguuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucaccuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggauccuugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugugacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaacagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauaggaaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacuguguguuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggacauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaaacauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucagaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaaucaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucacgcucucagugaacugccggagacccuagagacacugcuuuuacugacacuucuggcuacagucacaggagggaucuuuuuauucuugaugagcgggaggggcauagggaagaugaccuugggaaugugcugcauaaucacggcuagcauccuucuaugguacgcacagauacagccacacuggauagcagcuucaauaauacuggaguuuuuucucauaguuuuacuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaauguauccuuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggccuaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugccuucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaaaaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgacuggacacaagugcccuucuguucacaccauuuucaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6950 - RNA, 9876 nt, Artificial Sequence
  derived and/or modified CDS sequence (wt) from DENV-2__EU482676__SS-prME
ucugcaagcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaacugugugaagacacaaucacguacaaguguccucuucucaggcagaaugagccagaagacauagacuguuggugcaacuccacguccacguggguaaccuaugggaccuguaccacuacgggagagcauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuucguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauaaaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggagaaucgugcaaccagaaaauuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaccacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggauguauucugcgacucaaaacucaugucggcggccauaaaagacaacagagccguccaugccgacauggguuacuggauagaaagugcacucaaugacacauggaagauagagagagccuccuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaucuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuucuccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguagcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaagcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuauggcaaugguguugucacaaggaguggagcauaugugagugcuauagcccaaacugaaaaaagcauugaagacaaccccgagaucgaagaugacauuuuccgaaagagaagacugaccaucauggaucuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccauuagagcugagcacacugggcgggaaauuguggaucuaaugugucaugccacauuuacuaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuagcauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucuuugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggagggguauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggauuuuggauuaggaagcauugcaacccagcaacccgagagcaacauccuggauauagaccuacgucccgcaucagcuuggacgcuguaugccguggcuacaacauuuguuacaccaaugcugagacauagcauugagaauuccucagugaauguaucccuaacagcuauagccaaucaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccauuuccacacugugggaaggaaauccaggaagguucuggaacacuaccauugcagugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaagaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacugaugaaaaucacagcagaguggcuguggaaagaauuagggaagaaaaagacaccuaggaugugcaccagagaagaauucacaagaaaagugagaagcaaugcagccuugggggccauauucacugaugagaacaaguggaagucggcacgugaggcuguugaagauaguagguuuugggaguugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaacgaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaguuaaucagacagauggagggagaaggagucuuuaaaaacauccagcaccugacagucacagaagaaguugccgugcaaaacugguuggcaagaguggggcgcgaaagguugucaagaauggccaucaguggagaugacuguguugugaaaccuuuagaugacagguucgcaaacgcuuugacagcccuaaaugacaugggaaagauuagaaaagauauacagcagugggaaccuucaaaaggauggaacgauuggacacaagugcccuucuguucacaccauuuccaugagcuaaucaugaaggauggucguguacuuguuguuccauguagaaaccaagaugaacugaucggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagucccaucacacuggguuccaacaagucgaacaaccugguccauacacgccaaacaugaauggaugacaacggaagacauguuggcagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6951 - RNA, 9876 nt, Artificial Sequence
  derived and/or modified CDS sequence (wt) from DENV-2__EU482677__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcugguccauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacuauagucaucagagugcaauaugaaggggacggcucuccauguaaaaucccuuuugaaauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucgucacagacaaugugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauuuuagcagaaaaugaggugaaguugacuauuaugacaggagacauuaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacacuaccaccccuaagauacagaggugaggaugggugcugguacgggauggaaaucagaccauugaaagagaaagaagaaaaucugguuaacuccuuggucacagccggacaugggcagguugacaauuuuucacugggaguccugggaauggcauuguucuuggaggaaaugcuuaggacccgaguaggaacgaaacaugcaauacuacuaguugcaguuucuuuugugacacugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuucugacauccucacagcaaaaaacggauuggauaccauuagcauugacaaucaagggucucaauccaacagcuauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggugcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccugggaaaaauccaagagccguccaaacaaaaccuggucuuuucaaaaccagcaccggaacaauaggugccguaucucuggacuuuuccccuggaacgucaggaucuccaauuaucgacaaaaaaggaaaaguugugggucuuuaugguaaugguguugucacaaggaguggagcauauguaagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcacauuucacagacccagcaaguauagcagcuagaggauacaucucaacccgaguggaaaugggugaggcagcugggauuuucaugacagccacucccccgggaagcagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuaaaaccaaugacugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaucguuugagaggagaagcaaggaaaaccuuuguggacuuaaugaggagaggagacuuaccagucugguuggcuuacaaaguggcagcugaaggcaucaacuaugcagacagaaggugguguuuugaugggauuaagaacaaccaaauccuggaagaaaauguggaaguugaaaucuggacaaaagaaggggaaaggaagaaauugaaacccagaugguuggaugccaggaucuacucugacccacuggcgcuaaaagaguucaaagaauuugcagccggaagaaagucucugacccugaaccuaaucacagaaauggguaggcuuccaacauucaugacucagaaggcaagagacgcacuggacaaccuagcagugcugcacacggcugaagcagguggaagggcguacaaucaugcucucagugaacugccggagacccuagagacacugcuuuuacugacacuucuggcuacagucacaggaggaaucuuuuuauucuugaugagcgggaggggcauagggaagaugacccugggaaugugcugcauaaucacggcuagcauccuuuuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucgucacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuacgccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaccuacaagaaaaguggaauccaggaaguggauagaaccuuagcaaaagaaggcaucaaaagaggagaaacggaccaucacgcugugucgcgaggcucggcaaaacugagaugguucguugagagaaacauggucacaccagaagggaaaguaguggaccucgguuguggcagaggaggcuggucauauuauugcggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaaaugaaagugaaauaccaaaccuagacauaauugggaaaagaauagaaaaaauaaagcaagagcaugaaacaucauggcacuacgaccaagaccacccauacaaaacgugggcauaucaugguagcuaugaaacaaaacagacuggaucagcaucauccauggucaacggaguggucaggcugcugacaaaaccuugggacguccucccuacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaagcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccagagagguagugggcaaguuggcaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugacuguguugugaaaccuuuagacgacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucgugugcuuguuguuccauguagaaaccaagaugaacugauuggcagagcccgaaucucccaaggagcaggguggucuuugcgggagacggcuuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaaugguguggcucauugauuggguuaacaagcagggccacaugggcaaagaacauccaaguagcaauaaaucagguuagaucucuuauaggcaaugaggaauacacagauuacaugccauccaugaaaagauucagaagagaagaggaagaagcaggaguccugugguaa

SEQ ID NO: 6952 - RNA, 9876 nt, Artificial Sequence
  derived and/or modified CDS sequence (wt) from DENV-2__EU482678__SS-prME
ucggcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacgcuggauuucgaacugauaaaaacggaagccaaacagccugccacccuaagaaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggaguguuccccgagaacaggccucgacuucaaugagaugguguugcugcagauggaaaauaaagcuuggcuggugcauaggcaaugguuucuagaccugccauuaccauggcugcccggagcggaugaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcgaagagaauggccauuuugggugacacagccugggacuuuggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacgacagagugcccuaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugcugacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccaguaucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuucuggaggaaaugcuuaggacacgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauuggcaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccagguguuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagcuacucccccgggaaguagagauccauuuccucagagcaaugcaccaaucauagaugaagaaagagaaaucccugaacguucauggaauacuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguauguuaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggauuuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuacguuguaauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccguugauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuuuuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguaguuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuaggcuacauucuaagagacgugagcaagaaagagggaggagccauguacgccgacgacacagcaggaugggacacaagaaucacacuagaagaccuaaaaaaugaagaaaugguaacaaaccacaugaaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggaguuuuuaaaaacauccagcaccugacagucacagaagaaguugccgugcaaaacugguuggcaagaguggggcgcgaaagguugucaagaauggccaucaguggagaugauuguguugugaaaccuuuagaugacagguuugcaaacgcuuugacagcccuaaaugacaugggaaagauuagaaaagauauacaacaaugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaacuuggucuauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6953 - RNA, 9876 nt, Artificial Sequence
  derived and/or modified CDS sequence (wt) from DENV-2__EU482679__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccaccuuaaggaaguacugcauagaagcaaagcuaaccaacacaacaacagaaucccguugcccaacacaaggggaacccagccuaaaagaagagcaggauaagagguucgucuguaaacacuccaugguagacagaggauggggaaauggauguggauuauuuggaaagggaggcauugugaccugugcuauguucacaugcaaaaagaacauggaagggaaaaucgugcaaccagaaaacuuagaauauaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggacguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucauucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggugcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuucucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuucccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauacucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaauuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaacgauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauucgcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagugggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaauccaaccgucgauggaauaacagugauugauuuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacaccaccauugcggugucaauggccaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuacuguggaggacuaaaaaacguaagagaagugaaaggccuaacaaaaggaggaccaggacacgaagaacccaucccuaugucaacauauggguggaauuuggugcgucuucagaguggaguugacgucuucuucaucccgccagaaaagugugacacauuguugugugacauaggggagucaucaccaaaucccacaguagaagcaggacgaacacucagaguccuuaauuuaguagaaaauugguugaacaacaacacucaauuuugcauaaaaguucucaacccauacaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagcuacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauauaaaacgugggcauaccaugguagcuaugaaacaaaacagacuggaucagcaucauccaugguuaacggaguggucaggcugcugacaaaaccuugggauguccuccccacggugacacagauggcaaugacagauacgacuccauuuggacaacagcguguuuuuaaagaaaaaguggacacgagaacccaagaaccgaaagaaggcacgaagaaauuaaugaaaaucacagcagaguggcuguggaaagaauuagggaagaaaaagacaccuaggaugggcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuagguuuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagacuuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcagaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugccuuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccguacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6954 - RNA, 9876 nt, Artificial Sequence
  derived and/or modified CDS sequence (wt) from DENV-2__EU482774__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacucuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccuuggcugcccggagcggauaaacaagagucgaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaaucuucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccagccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugaccauuaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaagaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugguauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauucuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacagcagcagcaugguaucugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcucaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucaaagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacucaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccauuccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaauaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaaacaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcaaaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaauuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaacuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaucaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6955 - RNA, 9876 nt, Artificial Sequence
  derived and/or modified CDS sequence (wt) from DENV-2__EU482775__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaacuacagugauagugacugaggacugcggaaauagaggacccucuuugagaacaacuacugccucuggaaaacucauaacagaauggugcugccgaucuugcacauugccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgagugggaacgaaacaugcaauacuacuaguugcagucucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacuguguguuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugauuucaggacuuuuuccuauaucaauaccaaucacggcagcagcaugguacuugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucagaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggagguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6956 - RNA, 9876 nt, Artificial Sequence
  derived and/or modified CDS sequence (wt) from DENV-2__EU482776__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugcgugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagcuuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcagauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaagcucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguaugggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauagguaugggcgugacuuaucuugcccuacuagcagccuacaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagcgaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauacggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagaccuaccagucuggcuggcuuacaaaguggcagcugaaggcaucaacuaugcagacagaaggugguguuuugauggaauuaagaacaaccaaauccuggaagaaaauauggaaguugaaaucuggacaaaggaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacgagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcggguaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggccaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacuggggaaaagugaauuccagaucuacaagaaaaguggaauccaggaaguggauagaaccuuggcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaauguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaauccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacgaaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaagcaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcauaacugguuggcaagaguggggugcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguguacuuguuguuccauguagaaaccaagaugaacugauuggcagagcacgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucuagaaaacccauggauggaagacaaaaccccaguggaaucaugggaggaaaucccauacuugggaaaaagagaagaccaauggugcggcucauugauuggguuaacaagcagggccacuugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6957 - RNA, 9876 nt, Artificial Sequence
  derived and/or modified CDS sequence (wt) from DENV-2__EU482777__SS-prME
ucugcagguaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagucuugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacaaaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagacagcccagucaacauagaagcagaaccuccauucggagacagcuacaucauuauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaaucgugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucgaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacauacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuucgauuucugcgauggaacuacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaagucagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugugucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagcuaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuauuauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccaguaacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaauauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgcccugcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcacuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcgaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaccuggugcgucuccagaguggaguugacgucuucuucaucccgccagaaaagugugacacauuguugugugacauaggggagucaucgccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgcuaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6958 - RNA, 9876 nt, Artificial Sequence
  derived and/or modified CDS sequence (wt) from DENV-2__EU482778__SS-prME
acagcaggcgugauuauuauguuaauuccaacagcgauggcguuccauuuaaccacacguaauggagaaccacacaugaucguuggcagacaagagaaagggaaaagucuucuguuuaaaacagaggauggugugaacauguguacccucauggccauugaucuuggugaauugugugaagauacaaucacguacaagugcccccuccucaggcagaaugaaccagaagauauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggauuuugagacauccaggcuuuaccauaauggcagcaauccuggcauacaccguaggaacgacacauuuccaaagggcccugauuuucaucuuacuggcagcugucgcuccuucaaugacaaugcguugcauaggaauaucaaauagagacuuuguagaagggguuucaggaggaagcuggguugacauagucuuagaacauggaaguugcgugacgacaauggcaaaaaacaaaccaacauuggauuuugaacugauaaaaacugaagccaaacaaccugccacucuaaggaaguacuguauagaggcaaagcugaccaauacaacaacagaaucucguugcccaacacaaggggaacccagucuaaaugaagagcaggacaaaagguucgucugcaaacacuccaugguagacagaggauggggaaauggauguggauuauuuggaaagggaggcauugugaccugugcuauguucacaugcaaaaagaacauggaaggaaaaaucgugcaaccagaaaauuuggaauacaccaucgugauaacaccucacucaggagaagagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacacuggucacuuucaaaaauccccacgcgaagaaacaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccuuucggagacagcuacaucauuauaggaguagagccgggacaauugaaacucaacugguucaagaaaggaaguuccaucggccaaauguuugagacaacaaugagaggagcaaagagaauggcuauuuuaggugacacagccugggauuuuggaucucugggaggaguguuuacaucuauaggaaaggcucuccaccaaguuuucggagcaaucuauggggccgccuuuagcgggguuucauggacuaugaaaauccucauaggagucaucaucacauggauaggaaugaauucacguagcaccucacugucugugucacuaguauuggugggagucauaacacuguacuugggagcuauggugcaggcugauagugguugcguuguaagcuggaaaaacaaagaacugaaauguggcagcgggaucuucaucacagauaacgugcauacguggacagaacaauacaaguuccaaccagaauccccuucaaaauuagcuucagcuauccaaaaagcucaugaagaggguauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucccacaaccagaccuuucucauugauggcccugaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaaguuaaaaacugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggacggaugcugguaugggauggaaaucagaccauuaaaagagaaagaagagaauuuggucaacucccuggucacagccggacaugggcagauugacaacuuuucacuaggagucuugggaauggcacuauuccuggaagaaaugcucaggacacgaguaggaacgaaacaugcaauacugcuaguugcaguuucuuuugugacauugauuacugggaacauguccuuuagagauuugggaagagugaugguuauggugggcgcugccaugacggaugacauagguauaggagugacuuaucuugcccuacuggcagcuuucaaaguaagaccaacuuuugcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugaccaucauggccaucucgugugucccaaaugcagugauacugcaaaacgcauggaaggugagcugcacaauauuggcaacgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccacuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggaaguccaaguccuggcauuggaaccugggaaaaauccaagagcuguccaaacgaaaccuggacuuuucaaaaccaacaccggaaccauaggcgccguaucuuuggacuuuuccccuggaacgucaggaucuccaauugucgauaaaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguugagaugggugaagcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggauuuuguggucacaaccgacauuucagaaaugggugccaacuucaaggcugagaggguuauagaccccagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucugguuggcuuacagaguggcagcugaaggcaucaacuaugcagacagaaggugguguuuugauggagucaagaacaaccaaauacuagaagaaaacguggaaguggaaauuuggacaaaagaaggggaaaggaagaaauuaaaacccagaugguuggaugcuagaaucuauucugacccacuggcacuaaaagaauucaaggaauuugcggcuggaagaaaguccuugacccugaaccuaaucacagaaauggguagacuuccaacuuucaugacccagaaggcaagagacgcacuagacaaccuagcugugcugcauacggcugaggcagguggaagggcguacaaucaugcucucagugaacugccggagacccuugagacacuacuuuuacugacacuccuggcuacagucacgggaggaauuuucuuauucuuaaugaguggaaaagguguagggaagaugacccugggaaugugcugcauaauaacggcuagcauccuccuauggcaugcacagauacaaccacacuggauagcagcuucaauaauauuggaguuuuuucucauaguuuugcucauuccagagccagaaaaacagagaacaccccaagauaaccaacugaccuacguugucauagccauccucacagugguggccgcaaccauggcaaacgagauggguuuccuggaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuucaagcgaaagcaacuagagaagcucagaaaagagcagcagcaggcaucaugaaaaacccaacagucgauggaauaacagugauugaccuagauccaauacccuaugauccaaaauuugaaaaacagcuaggacaaguaaugcuccugauucucugcgugacucaaguauuaaugaugaggacuacaugggcuuugugugaggcucuaaccuuagcgaccgggcccaucuccacauugugggaagguaauccagggagguuuuggaacacuacuauugcagugucaauggcuaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacuaaagaauguaagagaagucaaaggccugacaaaaggaggaccaggacacgaagaaccaguccccaugucaacauauggguggaaucuaguacgccugcagaguggaguugacguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacauugcaaaggaaauauggaggagccuuagugaggaauccacucucacgaaacuccacacaugagauguacuggguauccaaugcuacugggaacauagugucgucagugaacaugaucucaaggaugcugauuaacagauucacaaugaaacacaagaaagccaccuacgagccagauguugaccuagggagcggaacccgcaacauuggaauugagagugagauaccaaaucuagacauaauaggaaagagaauagagaaaauaaaacaagagcaugaaacaucauggcacuaugaccaggaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcguguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagcuuugggggccauauucacugaugagaacaaauggaagucggcacgcgaggcuguugaagauaguagguuuugggagcugguugacaaggaaagaaaucuccaucuugaagggaagugugaaacauguguguacaacaugaugggaaagagagaaaagaaacuaggggaguucggcaaggcaaaagguagcagagccauaugguacauguggcuuggagcacgcuucuuggaguuugaagccuugggauucuugaaugaggaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagaccuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucggcaccuauggccuuaacacuuucaccaauauggaagcccaacuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuccaugaguuaaucaugaaagacggucgcgugcucguaguuccaugcagaaaccaagaugaacugaucggcagggcccgaauuucccagggagcuggguggucucugaaggagacggccuguuuggggaagucuuacgcucaaauguggagucugauguacuuccacagacgugaccucaggcuggcggcaaacgccauuugcucggcagucccgucacauuggguuccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 6959 - RNA, 9876 nt, Artificial Sequence
  derived and/or modified CDS sequence (wt) from DENV-2__EU482779__SS-prME
acagcaggcgugauuauuauguuaauuccaacagcgauggcguuccauuuaaccacacgaaauggagaaccacacaugaucguuggcagacaagagaaagggaaaagucuucuguuuaaaacagaggauggugugaacauguguacccucauggccauugaccuuggugaauugugugaagauacaaucacguacaagugcccccuccucaggcagaaugaaccagaagacauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggaucuugagacauccaggcuuuaccauaauggcagcaauccuggcauacaccguaggaacgacacauuuccaaagggcccugauuuucaucuuauuggcagcugucgcuccuucaaugacaaugcguugcauaggaauaucaaauagagacuuuguagaagggguuucaggaggaagcuggguugacauagucuuagaacauggaaguugugugacgacaauggcaaaaaauaaaccaacauuggauuuugaacugauaaaaacagaagccaaacaaccugccacucuaaggaaguacuguauagaggcaaagcugaccaauacaacaacagaaucucguugcccgacacagggggaacccaguuuaaaugaagagcaggacaaaagguucgucugcaaacacuccaugguagacagaggauggggaaauggauguggauuauuuggaaagggaggcauugugaccugugcuauguucacaugcaaaaagaacauggaaggaaaaaucgugcaaccagaaaauuuggaauacaccaucgugauaacaccccacucaggagaagagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaagcaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggacaaauguuugagacaacaaugagaggagcaaagagaauggccauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucacuaguauuggugggagucauaacacuguacuugggagccauggugcaggcugauagugguugcguugugagcuggaaaaacaaagaacugaaauguggcagcgggaucuucaucacagauaacgugcacacguggacagaacaauacaaguuccaaccagaauccccuucaaaauuagcuucagccauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauggcauuauuccuggaagaaaugcucaggacacgaguaggaacgaaacaugcaauacugcuaguuacaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuucgcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccucaaaauagugagaaauauggaaaaguaccaauuggcagugacuaucauggccaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaagaauccaagagcuguccaaacgaaaccuggacuuuucaaaaccaacaccggaaccauaggcgccguaucuuuggacuuuuccccuggaacaucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagaguuguggcagcugaaauggaggaagcccuuagaggacuuccaauaagauaccaaaccccagccaucagagccgagcacacugggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucuggcuggcuuacagaguggcagcugaaggcaucaacuacgcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuggauaaccuagcugugcugcauacggcugaggcagguggaagggcguacaaucaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuaugguaugcacagauacaaccacacuggauagcagcuucaauaauauuggaguuuuuucucauaguuuugcucauuccagaaccagaaaaacagagaacaccccaagauaaccaacugaccuacguuguuauagccauccucacagugguggccgcaaccauggcaaacgagauggguuuccuagaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuccaagcgaaagcaaccagagaagcucagaaaagagcagcagcaggcaucaugaaaaacccaacagucgauggaguaacagugauugaccuagauccaauacccuaugauccaaaauuugaaaaacagcuaggacaaguaaugcuccugauucucugcgugacucaaguacuaaugaugaggacuacaugggcuuugugugaggcucuaaccuuagcgaccgggcccaucuccacauugugggaagguaauccagggagauuuuggaacacuacuauugcagugucaauggcuaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacuggggaaaagugaauuucagaucuacaagaaaaguggaauccaggaaguggauagaaccuuagcaaaagaaggcaucaaaagaggagaaacggaccaccacgcugugucgcgagguucagcaaaacugagaugguucgucgagagaaauauggucacaccagaagggaaagugguggaccuugguugcggcagagggggcuggucauacuauugugggggacuaaaggauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucagugaacaugaucucaaggaugcugauuaacagauucacaaugaaacacaagaaagccaccuacgagccagauguugacuuagggagcggaacccgcaacauuggaauugaaagugagauaccaaaucuagacauaauaggaaagagaauagagaaaauaaaacaagagcaugaaacaucauggcacuaugaccaagaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaggugagaagcaaugcagccuugggggccauauucacugaugagaacaaauggaagucggcacgcgaggcuguugaagauagcagguuuugggagcugguugacaaggaaagaaaucuccaucuugaagggaagugugaaacauguguguacaacaugaugggaaagagagaaaagaaacuaggggaguucgguaaggcaaaggguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucgguaccuauggccucaacacuuucaccaauauggaagcccaauuaauuagacagauggagggagaaggaguuuucaaaagcauucagcgccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcuuguaguuccaugcagaaaccaagaugaacugauuggcagggcccgaauuucccagggagcuggguggucuuugaaggagacggccuguuuggggaaguccuacgcucaaauguggagucugauguacuuccacagacgugaccucaggcuggcggcaaaugcuauuugcucggcagucccgucacauugggucccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 6960 - RNA, 9876 nt, Artificial Sequence
  derived and/or modified CDS sequence (wt) from DENV-2__EU482780__SS-prME
acagcaggcgugauuauuauguuaauuccaacagcgauggcguuccauuuaaccacacgaaauggagaaccacacaugaucguuggcagacaagagaaagggaaaagucuucuguuuaaaacagaggauggugugaacauguguacccucauggccauugaccuuggugaauugugugaagauacaaucacguacaagugcccccuccucaggcagaaugaaccagaagacauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggaucuugagacauccaggcuuuaccauaauggcagcaauccuggcauacaccguaggaacgacacauuuccaaagggcccugauuuucaucuuauuggcagcugucgcuccuucaaugacaaugcguugcauaggaauaucaaauagagacuuuguagaagggguuucaggaggaagcuggguugacauagucuuagaacauggaaguugugugacgacaauggcaaaaaauaaaccaacacuggauuuugaacugauaaaaacagaagccaaacaaccugccacucuaaggaaguacuguauagaggcaaagcugaccaauacaacaacagaaucucguugcccaacacagggggaacccaguuuaaaugaagagcaggacaaaagguucgucugcaaacacuccaugguagacagaggauggggaaauggauguggauuauuuggaaagggaggcauugugaccugugcuauguucacauguaaaaagaacauggaaggaaaaaucgugcaaccagaaaauuuggaauacaccaucgugauaacaccccacucaggagaagagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaagcaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggacaaauguuugagacaacaaugagaggagcaaagagaauggccauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguugugagcuggaaaaacaaagaacugaaauguggcagcgggaucuucaucacagauaacgugcacacguggacagaacaauacaaguuccaaccagaauccccuucaaaauuagcuucagccauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauggcauuauuccuggaagaaaugcucaggacacgaguaggaacgaaacaugcaauacugcuaguuacaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuucgcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaagaauccaagagcuguccaaacgaaaccuggacuuuucaaaaccaacaccggaaccauaggcgccguaucuuuggacuuuuccccuggaacaucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagaguuguggcagcugaaauggaggaagcccuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucuggcuggcuuacagaguggcagcugaaggcaucaacuacgcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuggauaaccuagcugugcugcauacggcugaggcagguggaagggcguacaaucaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuaugguaugcacagauacaaccacacuggauagcagcuucaauaauauuggaguuuuuucucauaguuuugcucauuccagaaccagaaaaacagagaacaccccaagauaaccaacugaccuacguuguuauagccauccucacagugguggccgcaaccauggcaaacgagauggguuuccuagaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuccaagcgaaagcaaccagagaagcucagaaaagagcagcagcaggcaucaugaaaaacccaacagucgauggaguaacagugauugaccuagauccaauacccuaugauccaaaauuugaaaaacagcuaggacaaguaaugcuccugauucucugcgugacccaaguacuaaugaugaggacuacaugggcuuugugugaggcucuaaccuuagcgaccgggcccaucuccacauugugggaagguaauccagggagauuuuggaacacuacuauugcagugucaauggccaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacuggggaaaagugaauuucagaucuacaagaaaaguggaauccaggaaguggauagaaccuuagcaaaagaaggcaucaaaagaggagaaacggaccaccacgcugugucgcgagguucagcaaaacugagaugguucgucgagagaaauauggucacaccagaagggaaagugguggaccuugguugcggcagagggggcuggucauacuauugugggggacuaaaggauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucagugaacaugaucucaaggaugcugauuaacagauucacaaugaaacacaagaaagccaccuacgagccagauguugacuuagggagcggaacccgcaacauuggaauugaaagugagauaccaaaucuagacauaauaggaaagagaauagagaaaauaaaacaagagcaugaaacaucauggcacuaugaccaagaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaggugagaagcaaugcagccuugggggccauauucacugaugagaacaaauggaagucggcacgcgaggcuguugaagauagcagguuuugggagcugguugacaaggaaagaaaucuccaucuugaagggaagugugaaacauguguguacaacaugaugggaaagagagaaaagaaacuaggggaguucgguaaggcaaaggguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucgguaccuauggccucaacacuuucaccaauauggaagcccaauuaauuagacagauggagggagaaggaguuuucaaaagcauucagcgccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcaugcucguaguuccaugcagaaaccaagaugaacugauuggcagggcccgaauuucccagggagcuggauggucuuugaaggagacggccuguuuggggaaguccuacgcucaaauguggagucugauguacuuccacagacgugaccucaggcuggcggcaaaugcuauuugcucggcagucccgucacauugggucccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 6961 - RNA, 9876 nt, Artificial Sequence
  derived and/or modified CDS sequence (wt) from DENV-2__EU482781__SS-prME
acagcaggcgugauuauuauguuaauuccaacagcgauggcguuccauuuaaccacacgaaauggagaaccacacaugaucguuggcagacaagagaaagggaaaagucuucuguuuaaaacagaggauggugugaacauguguacccucauggccauugaccuuggugaauugugugaagauacaaucacguacaagugcccccuccucaggcagaaugaaccagaagacauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggaucuugagacauccaggcuuuaccauaauggcagcaauccuggcauacaccguaggaacgacacauuuccaaagggcccugauuuucaucuuauuggcagcugucgcuccuucaaugacaaugcguugcauaggaauaucaaauagagacuuuguagaagggguuucaggaggaagcuggguugacauagucuuagaacauggaaguugugugacgacaauggcaaaaaauaaaccaacacuggauuuugaacugauaaaaacagaagccaaacaaccugccacucuaaggaaguacuguauagaggcaaagcugaccaauacaacaacagaaucucguugcccaacacagggggaacccaguuuaaaugaagagcaggacaaaagguucgucugcaaacacuccaugguagacagaggauggggaaauggauguggauuauuuggaaagggaggcauugugaccugugcuauguucacauguaaaaagaacauggaaggaaaaaucgugcaaccagaaaauuuggaauacaccaucgugauaacaccucacucaggagaagagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaagcaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggacaaauguuugagacaacaaugagaggagcaaagagaauggccauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguugugagcuggaaaaacaaagaacugaaauguggcagcgggaucuucaucacagauaacgugcacacguggacagaacaauacaaguuccaaccagaauccccuucaaaauuagcuucagccauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcagccaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauggcauuauuccuggaagaaaugcucaggacacgaguaggaacgaaacaugcaauacugcuaguuacaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuucgcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaagaauccaagagcuguccaaacgaaaccuggacuuuucaaaaccaacaccggaaccauaggcgccguaucuuuggacuuuuccccuggaacaucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagaguuguggcagcugaaauggaggaagcccuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucuggcuggcuuacagaguggcagcugaaggcaucaacuacgcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuggauaaccuagcugugcugcauacggcugaggcagguggaagggcguacaaucaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuaugguaugcacagauacaaccacacuggauagcagcuucaauaauauuggaguuuuuucucauaguuuugcucauuccagaaccagaaaaacagagaacaccccaagauaaccaacugaccuacguuguuauagccauccucacagugguggccgcaaccauggcaaacgagauggguuuccuagaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuccaagcgaaagcaaccagagaagcucagaaaagagcagcagcaggcaucaugaaaaacccaacagucgauggaguaacagugauugaccuagauccaauacccuaugauccaaaauuugaaaaacagcuaggacaaguaaugcuccugauucucugcgugacccaaguacuaaugaugaggacuacaugggcuuugugugaggcucuaaccuuagcgaccgggcccaucuccacauugugggaagguaauccagggagauuuuggaacacuacuauugcagugucaauggccaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacuggggaaaagugaauuucagaucuacaagaaaaguggaauccaggaaguggauagaaccuuagcaaaagaaggcaucaaaagaggagaaacggaccaccacgcugugucgcgagguucagcaaaacugagaugguucgucgagagaaauauggucacaccagaagggaaagugguggaccuugguugcggcagagggggcuggucauacuauugugggggacuaaaggauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucagugaacaugaucucaaggaugcugauuaacagauucacaaugaaacacaagaaagccaccuacgagccagauguugacuuagggagcggaacccgcaacauuggaauugaaagugagauaccaaaucuagacauaauaggaaagagaauagagaaaauaaaacaagagcaugaaacaucauggcacuaugaccaagaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaggugagaagcaaugcagccuugggggccauauucacugaugagaacaaauggaagucggcacgcgaggcuguugaagauagcagguuuuggaagcugguugacaaggaaagaaaucuccaucuugaagggaagugugaaacauguguguacaacaugaugggaaagagagaaaagaaacuaggggaguucgguaaggcaaaggguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucgguaccuauggccucaacacuuucaccaauauggaagcccaauuaauuagacagauggagggagaaggaguuuucaaaagcauucagcgccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggauggucuuugaaggagacggccuguuuggggaaguccuacgcucaaauguggagucugauguacuuccacagacgugaccucaggcuggcggcaaaugcuauuugcucggcagucccgucacauugggucccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 6962 - RNA, 9876 nt, Artificial Sequence
  derived and/or modified CDS sequence (wt) from DENV-2__EU482782__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggauggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuuguagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaauauccagcacuugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6963 - RNA, 9876 nt, Artificial Sequence
  derived and/or modified CDS sequence (wt) from DENV-2__EU482783__SS-prME
acagcaggcgugauuauuauguuaauuccaacagcgauggcguuccauuuaaccacacgaaauggagaaccacacaugaucguuggcagacaagagaaagggaaaagucuucuguuuaaaacagaggauggugugaacauguguacccucauggccauugaccuuggugaauugugugaagauacaaucacguacaagugcccccuccucaggcagaaugaaccagaagacauagauuguuggugcaacuccacguccacauggguaacuuaugggacguguaccaccacgggagaacacagaagagaaaaaagaucaguggcacucguuccacauguggguaugggacuggagacacgaacugaaacauggaugucgucagaaggggccuggaaacacgcucagagaauugaaaccuggaucuugagacauccaggcuuuaccauaauggcagcaauccuggcauacaccguaggaacgacacauuuccaaagggcccugauuuucaucuuauuggcagcugucgcuccuucaaugacaaugcguugcauaggaauaucaaauagagacuuuguagaagggguuucaggaggaagcuggguugacauagucuuagaacauggaaguugugugacgacaauggcaaaaaauaaaccaacacuggauuuugaacugauaaaaacagaagccaaacaaccugccacucuaaggaaguacuguauagaggcaaagcugaccaauacaacaacagaaucucguugcccaacacagggggaacccaguuuaaaugaagagcaggacaaaagguucgucugcaaacacuccaugguagacagaggauggggaaauggauguggauuauuuggaaagggaggcauugugaccugugcuauguucacaugcaaaaagaacauggaaggaaaaaucgugcaaccagaaaauuuggaauacaccaucgugauaacaccucacucaggagaagagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaagcaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacggaaaaagauagcccagucaacauagaagcagaaccuccauucggagacagcuacaucauuauaggaguagagccgggacaauugaaacucaacugguucaagaaaggaaguuccaucggacaaauguuugagacaacaaugagaggagcaaagagaauggccauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguugugagcuggaaaaacaaagaacugaaauguggcagcgggaucuucaucacagauaacgugcacacguggacagaacaauacaaguuccaaccagaauccccuucaaaauuagcuucagccauccaaaaagcucaugaagagggcauuuguggaauccgcucaguaacaagauuggagaaucugauguggaaacaaauaacaccagaauugaaucacauucuaucagaaaaugagguaaaguugacuauuaugacaggaggcauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagaucgacaacuuuucacuaggagucuugggaauggcauuauuccuggaagaaaugcucaggacacgaguaggaacgaaacaugcaauacuacuaguuacaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuucgcagcuggacuacuacugagaaagcugaccuccaaggaauuaaugauggcuaccauaggaaucgcgcuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguagcuggagggcuccuuacuguguguuacgugcuuacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuacagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaagaauccaagagcuguccaaacgaaaccuggacuuuucaaaaccaacaccggaaccauaggcgccguaucuuuggacuuuuccccuggaacaucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcucccacuagaguuguggcagcugaaauggaggaagcccuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaagccgcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugauauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucugguuggcuuacagaguggcagcugaaggcaucaacuacgcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuggauaaccuagcugugcugcauacggcugaggcagguggaagggcguacaaccaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuaugguaugcacagauacaaccacacuggauagcagcuucaauaauauuggaguuuuuucucauaguuuugcucauuccagaaccagaaaaacagagaacaccccaagauaaccaacugaccuacguuguuauagccauccucacagugguggccgcaaccauggcaaacgagauggguuuccuagaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuccaagcgaaagcaaccagagaagcucagaaaagagcagcagcaggcaucaugaaaaacccaacagucgauggaauaacagugauugaccuagauccaauacccuaugauccaaaauuugaaaaacagcuaggacaaguaaugcuccugauucucugcgugacucaaguacuaaugaugaggacuacaugggcuuugugugaggcucuaaccuuagcgaccgggcccaucuccacauugugggaagguaauccagggagauuuuggaacacuacuauugcagugucaauggcuaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacuggggaaaagugaauuucagaucuacaagaaaaguggaauccaggaaguggauagaaccuuagcaaaagaaggcaucaaaagaggagaaacggaccaccacgcugugucgcgagguucagcaaaacugagaugguucgucgagagaaauauggucacaccagaagggaaagugguggaccuugguugcggcagagggggcuggucauacuauugugggggacuaaaggauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucagugaacaugaucucaaggaugcugauuaacagauucacaaugaaacacaagaaagccaccuacgagccagauguugacuuagggagcgggacccgcaacauuggaauugaaagugagauaccaaaucuagacauaauaggaaagagaauagagaaaauaaaacaagagcaugaaacaucauggcacuaugaccaagaccacccauacaaaacaugggcuuaucauggcagcuaugaaacaaaacagacuggaucggcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaggugagaagcaaugcagccuugggggccauauucacugaugagaacaaauggaagucggcacgcgaggcuguugaagauagcagguuuugggagcugguugacaaggaaagaaaucuccaucuugaagggaagugugaaacauguguguacaacaugaugggaaagagagaaaagaaacuaggggaguucgguaaggcaaaggguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucgguaccuauggccucaacacuuucaccaauauggaagcccaauuaauuagacagauggagggagaaggaguuuucaaaagcauucagcgccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggguggucuuugaaggagacggccuguuuggggaaguccuacgcucaaauguggagucugauguacuuccacagacgugaccucaggcuggcggcaaaugcuauuugcucggcagucccgucacauugggucccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 6964 - RNA, 9876 nt, Artificial Sequence
  derived and/or modified CDS sequence (wt) from DENV-2__EU482784__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagauggugcugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggauguauuuugugacucaaaacucaugucagcagccauaaaagacagcagagccguccacgccgauauggguuacuggauagaaagcgcacucaaugacacauggaagauugagaaagccucuuuuauugaaguuaagagcugccacuggccaaagucacacacucucuggaguaauggagugcuagaaagugagaugauaauuccaaagaauuuugcaggaccagugucacaacacaauuacagaccaggcuaucauacacaaacggcaggacccuggcauuuaggcaggcuugagauggacuucgauuucugcgaaggaaccacagugguggugacugaggacuguggaaauagaggacccucuuuaagaacaacuacugcuucuggaaaacucauaacagagugguguugccgaucuugcacauuaccaccgcuaagguacagaggugaggauggaugcugguauggaauggaaauuagaccauugaaagagaaagaagagaacuuggucaacucuuuggucacagccggacauggacagauugauaacuuuucacuaggagucuugggaauggcacuguuccuggaagagaugcucaggacccgaauaggaacgaaacaugcaauauuauuaguugcaguuucuuucgugacauugaucacagggaacauguccuuucgagauuuggggagagugauggucauggugggcgcuacuaugacggaugacauaggcaugggcgugacuuaucucgcccuauuagcagccuucaaaguuagaccaacuuuugcagcuggacuacucuuaagaaagcugaccuccaaggaauugaugaugacuaccauaggaauuguacuccucucccaaaguacuauaccagagaccguucuugaauugacugaugcguuagccuuaggcaugaugguucuuaaaauagugagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauacccuuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaggaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguagccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacuaagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauaccuucaccaacauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6965 - RNA, 9876 nt, Artificial Sequence
  derived and/or modified CDS sequence (wt) from DENV-2__EU482785__SS-prME
acagcaggcgugauuauuauguuaauuccaacagcgauggcguuccauuuaaccacacgaaauggagaaccacacaugaucguuggcagacaagagaaagggaaaagucuucuguuuaaaacagaggauggugugaacauguguacccucauggccauugaccuuggugaauugugugaagauacaaucacguacaagugcccccuccucaggcagaaugaaccagaagacauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggaucuugagacauccaggcuuuaccauaauggcagcaauccuggcauacaccguaggaacgacacauuuccaaagggcccugauuuucaucuuauuggcagcugucgcuccuucaaugacaaugcguugcauaggaauaucaaauagagacuuuguagaagggguuucaggaggaagcuggguugacauagucuuagaacauggaaguugugugacgacaauggcaaaaaauaaaccaacacuggauuuugaacugauaaaaacagaagccaaacaaccugccacucuaaggaaguacuguauagaggcaaagcugaccaauacaacaacagaaucucguugcccaacacagggggaacccaguuuaaaugaagagcaggacaaaagguucgucugcaaacacuccaugguagacagaggauggggaaauggauguggauuauuuggaaagggaggcauugugaccugugcuauguucacauguaaaaagaacauggaaggaaaaaucgugcaaccagaaaauuuggaauacacuaucgugauaacaccucacucaggagaagagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaagcaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggacaaauguuugagacaacaaugagaggagcaaagagaauggccauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguugugagcuggaaaaacaaagaacugaaauguggcagcgggaucuucaucacagauaacgugcacacguggacagaacaauacaaguuccaaccagaauccccuucaaaauuagcuucagccauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacaucaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauggcauuauuccuggaagaaaugcucaggacacgaguaggaacgaaacaugcaauacugcuaguuacaguuucuuuugugacauugauuacuggaaacauguccuuuagagaucugggaagagugaugguuauggugggcgcugccaugacggaugacauagguaugggagugacuuaucuugcccuacuggcagcuuucaaaguaagaccaacuuucgcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccguggaaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaagaauccaagagcuguccaaacgaaaccuggacuuuucaaaaccaacaccggaaccauaggcgccguaucuuuggacuuuuccccuggaacaucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagaguuguggcagcugaaauggaggaagcccuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaacgauugggacuuuguggucacaaccgacauuucagaaaugggugccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucuggcuggcuuacagaguggcagcugaaggcaucaacuacgcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuggauaaccuagcugugcugcauacggcugaggcagguggaagggcguacaaucaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuaugguaugcacagauacaaccacacuggauagcagcuucaauaauauuggaguuuuuucucauaguuuugcucauuccagaaccagaaaaacagagaacaccccaagauaaccaacugaccuacguuguuauagccauccucacagugguggccgcaaccauggcaaacgagauggguuuccuagaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuccaagcgaaagcaaccagagaagcucagaaaagagcagcagcaggcaucaugaaaaacccaacagucgauggaguaacagugauugaccuagauccaauacccuaugauccaaaauuugaaaaacagcuaggacaaguaaugcuccugauucucugcgugacccaaguacuaaugaugaggacuacaugggcuuugugugaggcucuaaccuuagcgaccgggcccaucuccacauugugggaagguaauccagggagauuuuggaacacuacuauugcagugucaauggccaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacuggggaaaagugaauuucagaucuacaagaaaaguggaauccaggaaguggauagaaccuuagcaaaagaaggcaucaaaagaggagaaacggaccaccacgcugugucgcgagguucagcaaaacugagaugguucgucgagagaaauauggucacaccagaagggaaagugguggaccuugguugcggcagagggggcuggucauacuauugugggggacuaaaggauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucagugaacaugaucucaaggaugcugauuaacagauucacaaugaaacacaagaaagccaccuacgagccagauguugacuuagggagcggaacccgcaacauuggaauugaaagugagauaccaaaucuagacauaauaggaaagagaauagagaaaauaaaacaagagcaugaaacaucauggcacuaugaccaagaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaggugagaagcaaugcagccuugggggccauauucacugaugagaacaaauggaagucggcacgcgaggcuguugaagauagcagguuuugggagcugguugacaaggaaagaaaucuccaucuugaagggaagugugaaacauguguguacaacaugaugggaaagagagaaaagaaacuaggggaguucgguaaggcaaaggguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucgguaccuauggccucaacacuuucaccaauauggaagcccaauuaauuagacagauggagggagaaggaguuuucaaaagcauucagcgccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggauggucuuugaaggagacggccuguuuggggaaguccuacgcucaaauguggagucugauguacuuccacagacgugaccucaggcuggcggcaaaugcuauuugcucggcagucccgucacauugggucccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 6966 - RNA, 9876 nt, Artificial Sequence
  derived and/or modified CDS sequence (wt) from DENV-2__EU482786__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacucuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucgaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacaggaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccagccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguuccuggaagaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugguauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucaaagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacucaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugauggagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggccuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccauuccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcaaaguggcuguggaaagaacuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaauuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaacuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuucacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6967 - RNA, 9876 nt, Artificial Sequence
  derived and/or modified CDS sequence (wt) from DENV-2__EU482787__SS-prME
acagcaggcgugauuauuauguuaauuccaacagcgauggcguuccauuuaaccacacgaaauggagaaccacacaugaucguuggcagacaagagaaagggaaaagucuucuguuuaaaacagaggauggugugaacauguguacccucauggccauugaccuuggugaauugugugaagauacaaucacguacaagugcccccuccucaggcagaaugaaccagaagacauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggauccugagacauccaggcuuuaccauaauggcagcaauccuggcauacaccguaggaacgacacauuuccaaagggcccugauuuucaucuuauuggcagcugucgcuccuucaaugacaaugcguugcauaggaauaucaaauagagacuuuguagaagggguuucaggaggaagcuggguugacauagucuuagaacauggaaguugugugacgacaauggcaaaaaauaaaccaacacuggauuuugaacugauaaaaacagaagccaaacaaccugccacucuaaggaaguacuguauagaggcaaagcugaccaauacaacaacagaaucucguugcccaacacagggggaacccaguuuaaaugaagagcaggacaaaagguucgucugcaaacacuccaugguagacagaggauggggaaauggauguggauuauuuggaaagggaggcauugugaccugugcuauguucacauguaaaaagaacauggaaggaaaaaucgugcaaccagaaaauuuggaauacaccaucgugauaacaccucacucaggagaggagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaagcaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggacaaauguuugagacaacaaugagaggagcaaagagaauggccauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguugugagcuggaaaaacaaagaacugaaauguggcagcgggaucuucaucacagauaacgugcacacguggacagaacaauacaaguuccaaccagaauccccuucaaaauuagcuucagccauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauggcauuauuccuggaagaaaugcucaggacacgaguaggaacgaaacaugcaauacugcuaguuacaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuucgcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacuuaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaagaauccaagagcuguccaaacgaaaccuggacuuuucaaaaccagcaccggaaccauaggcgccguaucuuuggacuuuuccccuggaacaucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagaguuguggcagcugaaauggaggaagcccuuagaggacuuccaauaagauaccaaaccccagccaucagagccgagcacaccgggcgggagauuguggaccuaaugugucaugccacauucacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagccaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucuggcuggcuuacagaguggcagcugaaggcaucaacuacgcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuggauaaccuagcugugcugcauacggcugaggcagguggaagggcguacaaucaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuaugguaugcacagauacaaccacacuggauagcagcuucaauaauauuggaguuuuuucucauaguuuugcucauuccagaaccagaaaaacagagaacaccccaagauaaccaacugaccuacguuguuauagccauccucacagugguggccgcaaccauggcaaacgagauggguuuccuagaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuccaagcgaaagcaaccagagaagcucagaaaagagcagcagcaggcaucaugaaaaacccaacagucgauggaguaacagugauugaccuagauccaauacccuaugauccaaaauuugaaaaacagcuaggacaaguaaugcuccugauucucugcgugacucaaguacuaaugaugaggacuacaugggcuuugugugaggcucuaaccuuagcgaccgggcccaucuccacauugugggaagguaauccagggagauuuuggaacacuacuauugcagugucaauggccaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgagguucagcaaaacugagaugguucgucgagagaaauauggucacaccagaaggaaaagugguggaccuugguugcggcagagggggcuggucauacuauugugggggacuaaaggauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucagugaacaugaucucaaggaugcugauuaacagauucacaaugaaacacaagaaagccaccuacgagccagauguugacuuagggagcggaacccgcaacauuggaauugaaagugagauaccaaaucuagacauaauaggaaagagaauagagaaaauaaaacaagagcaugaaacaucauggcacuaugaccaagaccacccauacaaaacaugggcuuaccauggcagcuaugaaacaaaacaaacuggaucagcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaggugagaagcaaugcagccuugggggccauauucacugaugagaacaaauggaagucggcacgcgaggcuguugaagauagcagguuuugggagcugguugacaaggaaagaaaucuccaucuugaagggaagugugaaacauguguguacaacaugaugggaaagagagaaaagaaacuaggggaguucgguaaggcaaaggguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucgguaccuauggccucaacacuuucaccaauauggaagcccaauuaauuagacagauggagggagaaggaguuuucaaaagcauucagcgccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggauggucuuugaaggagacggccuguuuggggaaguccuacgcucaaauguggagucugauguacuuccacagacgugaccucaggcuggcggcaaaugcuauuugcucggcagucccgucacauugggucccaacaagucgaacaaccuggucuauacacgccaagcaugaauggaugacgacggaagacaugcugacagucuggaacaggguguggauccaagaaaacccuuggauggaagacaaaacuccaguagagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 6968 - RNA, 9876 nt, Artificial Sequence
  derived and/or modified CDS sequence (wt) from DENV-2__EU482788__SS-prME
acagcaggcgugauuauuauguuaauuccaacagcgauggcguuccauuuaaccacacgaaauggagaaccacacaugaucguuggcagacaagagaaagggaaaagucuucuguuuaaaacagaggauggugugaacauguguacccucauggccauugaccuuggugaauugugugaagauacaaucacguacaagugcccccuccucaggcagaaugaaccagaagacauagauuguuggugcaacuccacguccacauggguaacuuaugggacguguaccaccacgggagaacacagaagagaaaaaagaucaguggcacucguuccacauguggguaugggacuggagacacgaacugaaacauggaugucgucagaaggggccuggaaacacgcucagagaauugaaaccuggaucuugagacauccaggcuuuaccauaauggcagcaauccuggcauacaccguaggaacgacacauuuccaaagggcccugauuuucaucuuauuggcagcugucgcuccuucaaugacaaugcguugcauaggaauaucaaauagagacuuuguagaagggguuucaggaggaagcuggguugacauagucuuagaacauggaaguugugugacgacaauggcaaaaaauaaaccaacacuggauuuugaacugauaaaaacagaagccaaacaaccugccacucuaaggaaguacuguauagaggcaaagcugaccaauacaacaacagaaucucguugcccaacacagggggaacccaguuuaaaugaagagcaggacaaaagguucgucugcaaacacuccaugguagacagaggauggggaaauggauguggauuauuuggaaagggaggcauugugaccugugcuauguucacaugcaaaaagaacauggaaggaaaaaucgugcaaccagaaaauuuggaauacaccaucgugauaacaccucacucaggagaagagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaagcaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggacaaauguuugagacaacaaugagaggagcaaagagaauggccauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucauugucugugucacuaguauuggugggagucauaacacuguacuugggagcuauggugcaggcugauagugguugcguugugagcuggaaaaacaaagaacugaaauguggcagcgggaucuucaucacagauaacgugcacacguggacagaacaauacaaguuccaaccagaauccccuucaaaauuagcuucagccauccaaaaagcucaugaagagggcauuuguggaauccgcucaguaacaagauuggagaaucugauguggaaacaaauaacaccagaauugaaucacauucuaucagaaaaugagguaaaguugacuauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauggcauuauuccuggaagaaaugcucaggacacgaguaggaacgaaacaugcaauacugcuaguuacaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuucgcggcuggacuacuacugagaaagcugaccuccaaggaauuaaugauggcuaccauaggaaucgcgcuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguagcuggagggcuccuuacuguguguuacgugcucacuggacgaucggccgauuuggaacuggagagagccaccgaugucaaaugggaagaccaggcagaaauaucaggaagcagcccaauccugucaauaacgauagcagaagauggcagcaugucgauaaaaaaugaagaggaagaacaaacauugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaagaauccaagagcuguccaaacgaaaccuggacuuuucaaaaccaacaccggaaccauaggcgccguaucuuuggacuuuuccccuggaacaucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcucccacuagaguuguggcagcugaaauggaggaagcccuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaagccgcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugauauagcagcuugucucaggaaaaauggaaagaaagugauacaacucaguaggaagaccuuugacuccgaguauguuaagacuaggaccaaugauugggacuuuguggucacaaccgacauuucagaaaugggugccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucugguuggcuuacagaguggcagcugaaggcaucaacuacgcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuuuaugacccagaaggcaagaaacgcacuggauaaccuagcugugcugcauacggcugaggcagguggaagggcguacaaucaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuaugguaugcacagauacaaccacacuggauagcagcuucaauaauauuggaguuuuuucucauaguuuugcucauuccagaaccagaaaaacagagaacaccccaagauaaccaacugaccuacguuguuauagccauccucacagugguggccgcaaccauggcaaacgagauggguuuccuagaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuccaagcgaaagcaaccagagaagcucagaaaagagcagcagcaggcaucaugaaaaacccaacagucgauggaauaacagugauugaccuagauccaauacccuaugauccaaaauuugaaaaacagcuaggacaaguaaugcuccugauucucugcgugacucaaguacuaaugaugaggacuacaugggcuuugugugaggcucuaaccuuagcgaccgggcccaucuccacauugugggaagguaauccagggagauuuuggaacacuacuauugcagugucaauggcuaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacuggggaaaagugaauuucagaucuacaagaaaaguggaauccaggaaguggauagaaccuuagcaaaagaaggcaucaaaagaggagaaacggaccaccacgcugugucgcgagguucagcaaaacugagaugguucgucgagagaaauauggucacaccagaagggaaagugguggaccuugguugcggcagagggggcuggucauacuauugugggggacuaaaggauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucagugaacaugaucucaaggaugcugauuaacagauucacaaugaaacacaagaaagccaccuacgagccagauguugacuuagggagcgggacccgcaacauuggaauugaaagugaaauaccaaaucuagacauaauaggaaagagaauagagaaaauaaaacaagagcaugaaacaucauggcacuaugaccaagaccacccauacaaaacaugggcuuaucauggcagcuaugaaacaaaacagacuggaucggcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaggugagaagcaaugcagccuugggggccauauucacugaugagaacaaauggaagucggcacgcgaggcuguugaagauagcagguuuugggagcugguugacaaggaaaggaaucuccaucuugaagggaagugugaaacuuguguguacaacaugaugggaaagagagaaaagaaacuaggggaguucgguaaggcaaaggguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucgguaccuauggccucaacacuuucaccaauauggaagcccaauuaauuagacagauggagggagaaggaguuuucaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggguggucuuugaaggagacggccuguuuggggaaguccuacgcucaaauguggagucugauguacuuccacagacgugaccucaggcuggcggcaaaugcuauuugcucggcagucccgucacauugggucccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 6969 - RNA, 9876 nt, Artificial Sequence
  derived and/or modified CDS sequence (wt) from DENV-2__EU482697__SS-prME
ucugcaggcaugaucauuauguugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcacugucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucuguaucauuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaucaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaaugacggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcaguuggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacagagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacuaaccaucauggaccuccacccaggagcaggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagagaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcauuaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaauuacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaauacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaacugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccauggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaauuuccaucuugaaggaaagugugagacauguguguacaacaugaugggaaaaagagagaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagagaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugaaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgagagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagacuacaugccauccaugaaaagauucagaagagaagaggaagaagcaggaguccugugguaa

SEQ ID NO: 6970 - RNA, 9876 nt, Artificial Sequence
  derived and/or modified CDS sequence (wt) from DENV-2__EU482699__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaaggaaaaaucgugcaaccagaaaacuuggaauacaccauugugguaacaccccacucaggggaggagcaugcggucggaaaugacacaggaaaacacggcaaggaaaucaaagugacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauugccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacguggauaggaaugaacucacgcagcaccucacuaucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucucacaaccaaaccuuucucauugauggccccgagacggcagagugccccaacacaaauagagcuuggaacucguuggagguugaagacuacggcuuuggaguguucaccaccaauauauggcuaagauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggaccuucuuugagaacaacuacugccucuggaaaacucauaacagaauggugcugucgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggaaucuugggaauggcauuguuccuggaggaaaugcuuaggacccgaguaggaacgaaacaugcaauacuacuagcugcaguuucuuuugugacauugaucacagggaacauguccuucaaagaccuaggaagagugaugguuaugguaggcgcuacaauggcggaugacauagguaugggcgugacuuaucuugcccuacuagcagccuucaaaguuagaccaacuuuugcagcugggcuacucuugagaaggcugaccuccaaggaauugaugaugacuaccauaggaauuguacuccucucccaaaguacuauaccagagaccguucuugaauugacugaugcguuagccuuaggcaugaugguccuuaaaauaguaagaaaaauggaaaaguaucaauuagcagugacuaucauggcuaucuugugugucccaaacgcagugauacuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccgugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccagaccccagccauuagagcugagcacacugggcgggaaauuguggaucuaaugugucaugccacauuuacaaugaggcugcuaucaccaguuagagugccaaauuauaacuugauuaucauggaugaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuagcaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggacccaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaaucaagaacaaccaaauccuggaagaaaauguggaaguugaaaucuggacaaaaggaggggaaaagaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauaguauugagaauuccucagugaauguaucccuaacagcuauagccaaccaagcaacaguguuaaugggucuagggaaaggauggccauuaucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcggguaucaugaaaaacccaaccgucgauggaauaacagugauugaucuagauccaauaccuuaugacccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacugaaaaacguaagagaagugaaaggccuaacaaaaggaggaccaggacacgaagaacccauccccaugucaacguauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaacugguugaacaacaacacucaauuuugcauaaaaguccucaacccauauaugcccucaguuauagaaaaaauggaagcacugcaaaggaaauauggaggagccuuaguaagaaauccacucucacggaacuccacacaugagauguacuggguauccaaugcuucugggaacauagugucaucagugaacaugauuucaaggauguugaucaauagauucacaaugagacacaagaaagccacuuacgagccagauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacggacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccugaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguagugcgugugcaaagaccaacaccaagaggaacaguaauggacaucauaucgagaagagaccaaagagguagugggcaaguugguaccuauggacucaacacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6971 - RNA, 9876 nt, Artificial Sequence
  derived and/or modified CDS sequence (wt) from DENV-2__EU482701__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaagcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagaacaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaagugacaccacagaguuccaucacagaagcagaauugaccgguuauggcaccgucacgauggagugcuccccgagaacaggccucgacuucaaugagaugguguugcugcagauggaaaauaaagcuuggcuagugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcaugcagcacucacaggagccacagaaauccaaaugucgucaggaaacuuacucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguuuaagaaaggaaguucuaucggccaaauguuugagacaacgaugagaggggcgaagagaauggccauuuugggugacacagccugggacuuuggaucccuaggaggaguguuuacauccauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucucacaaccaaaccuuucucauugauggccccgagacggcagagugccccaacacaaauagagcuuggaacucguuggagguugaagacuacggcuuuggaguguucaccaccaauauauggcuaagauugaaagaaaaacaggaugcauucugcgacucaaaacucaugucggcggccguaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugguaaucccaaagaaucucgcuggaccagugucucaacacaacuauagaccagguuaccauacacaaauagcaggaccauggcaccuagguaagcuugagauggacuuugauuucugcgauggaaccacagugauagugacugaggacugcggaaauagaggaccuucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggaaucuugggaauggcauuguuccuggaggaaaugcucaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuauuagcagccuucaaaguuagaccaacuuuugcagcugggcuacucuugagaaagcugaccuccaaggaauugaugaugacuaccauaggaguuguacuccucucccaaaguacuauaccagacaccguucuugaauugacugaugcguuagccuuaggcaugaugguccuuaaaauaguaagaaacauggaaaaguaucaauuagcagugacuaucauggcuaucuugugugucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacucuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccgugucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaagcgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuacaaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuagcaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacacauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggccuacaaaguggcagcugaaggcaucaacuaugcagacagaaggugguguuuugauggaauuaagaacaaccaaauccuggaagaaaauguggaagucgaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacccagaagacaagagacgcacuggacaaccuagcagugcugcacacggcugaagcagguggaagggcguacaaucaugcucucagugaacugccggagacccuagagacacugcuuuuacugacacuucuggcuacagucacaggaggaaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauaguauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaggcaaccagagaagcccagaaaagagcagcggcggguaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucaggguccuuaauuuaguagaaaacugguugaacaacaacacucaauuuugcauaaaaguucucaacccauauaugcccucaguuauagaaaaaauggaagcacugcaaaggaaauauggaggagccuuagugaggaauccacucucacggaacuccacacaugagauguacuggguauccaaugcuucugggaacauagugucaucagugaacaugaucucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccauggcagcuaugaaacaaaacagacuggaucagcaucauccauggucaacggaguggucaggcugcugacaaaaccuugggacguccuccccacgguaacacagauggcaaugacagacacaacuccauuuggacaacagcguguuuuuaaagaaaaaguggacacgagaacccaagaaccgaaagaaggcacgaagaaauuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucucgaaggaaagugugagacauguguguacaacaugauggggaaaagagaaaagaagcuaggggaauucggcaaggcaaaaggcagcagagccauaugguacauguggcuuggagcucgcuuccuggaguuugaagcccuaggauuccugaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaacacuuucaccaauauggaagcccaauuaaucagacagauggagggagaaggaguguuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaagggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuucacaggcgugaccucaggcuggcggcaaaugccauuugcucggcagugccaucacacuggguuccaacaagucgaacaaccugguccauacacgccaaacaugaauggaugacaacggaagacauguugacagucuggaacagaguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggagucuugugguaa

SEQ ID NO: 6972 - RNA, 9876 nt, Artificial Sequence
  derived and/or modified CDS sequence (wt) from DENV-2__EU482703__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagauacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuguuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuuuaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauucgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucauucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuggguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauugugcuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaaguggguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuauuauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauaucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaagaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaagguggaugccauugauggcgaauaccguuugagaggagaagcaaggaaaacauuuguggacuuaaugagaagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacagugcuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagagaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacuacaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguaguuaugaaacaaaacagacuggaucagcaucauccauggucaacggaguggucaggcugcugacaaaaccuugggacguccuccccacggugacacagauggcaaugacagauacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaaaaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaagguagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacaugaaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugaucggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6973 - RNA, 9876 nt, Artificial Sequence
  derived and/or modified CDS sequence (wt) from DENV-2__EU482705__SS-prME
ucggcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccugcaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacgcuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcuucccggagcggauaaacaagagucaaauuggauacagaaagaaacauuggucacuuucaaaaauccccaugcgaagaaacaggauguuguuguuuuaggaucccaagaaggggccaugcacacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaauauagaagcagaaccuccauucggagacagcuacaucaucauaggaguagagccgggacaacugaaacucaauugguucaagaaaggaaguucuauuggccaaauguuugagacaacgaugagaggggcgaagagaauggccauuuugggugacacagccugggacuuuggaucccugggaggaguguuuacaucuauaggaaaagcucuucaccaagucuuuggagcaaucuauggagcugccuucagugggguuucauggaccaugaaaauccucauaggagucauuaucacauggauaggaaugaacucacgcagcaccucacuguccgugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacgacagagugcccuaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacacgggcagguugacaauuuuucacugggggucuugggaauggcauuguuccuggaggaaaugcuuaggacacgaguaggaacgaaacaugcaauacuacuaguugcaguuucuuuugugacauugaucacagggaacauguccuucaaagaccuaggaagaguggugguuaugguaggcgcuacaauggcggauaacauagguaugggcgugacuuaucuugcccuacuagcagccuucaaaguuagaccaacuuuugcagcugggcuacucuugagaaggcugaccuccaaggaauugaugaugacuaccauaggaauuguacuccucucccaaaguaccauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguauccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaacgaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaaacaaaaagggauucuuggauauucucagaucggagcuggaguuuacaaagaaggaacauuucauacaauguggcaugucacacguggcgcuguccuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugauauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggaugaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacacgagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggauuuuuuuauuccugaugagcgggaggggcauagggaagaugacccugggaaugugcugcauaaucacggccagcauccuucuaugguacgcacaaauacagccacacuggauagcagcuucaauaauacuggaguuuuuucucauaguuuugcucauuccagaaccagaaaaacagagaacaccccaagacaaccaauugaccuacguugucauagccauccucacagugguggcugcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaauggguuuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccguugauggaauaacagugauugaucuagauccaauaccuuaugauccaaaguuugaaaagcaguugggacaaguaaugcuacuaauccucugcgugacucaaguacugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuuuuucaucccgccagaaaagugugacacauuguugugugacauaggggagucaucaccaaaucccacaguggaagcaggacgaacacucagaguccuuaauuuaguagaaaauugguugaacaacaacacucaguuuugcauaaaaguucucaacccauauaugcccucaguuauagaaaaaauggaagcacugcaaaggaaauauggaggagccuuagugagaaauccacucucacggaacuccacacaugagauguacuggguauccaaugccucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguaguuaugaaacaaaacagacuggaucagcaucauccauggucaacggaguggucaggcugcugacaaagccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuagaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagagauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccuggucuauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcgauaaaucagguuagaucucuuauaggcaaugaggaauacacagauuacaugccauccaugaaaagauucagaagagaagaggaagaagcaggaguccugugguaa

SEQ ID NO: 6974 - RNA, 9876 nt, Artificial Sequence
  derived and/or modified CDS sequence (wt) from DENV-2__EU482463__SS-prME
ucugcaggcaugaucauuaugcugauuccaacagugauggcguuucaucuaaccacacgcaacggagaaccacacaugaucgucaguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacacagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauucuggcauacaccauagggacgacacauuuccagagaguccugauuuucauucuacugacagccgucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacagaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggaguguuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucaccuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggauccuugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugugacucaaaacucaugucggcggccauaaaagacaacagagccguccaugccgacauggguuacuggauagaaagugcacucaaugacacauggaagauagagaaagccucuuucauugaagugaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauaggaaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacuguguguuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggcgccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugcuugagaaaaaauggaaagaaaguaauacaacuuaguaggaagacuuuugauucagaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacucugaaccuaaucacagaaauggguaggcuuccaacauucaugacucagaagacaagagacgcacuggacaaccuagcagugcugcacacggcugaagcagguggaagggcguacaaucacgcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuagaguuuuuucucauaguuuuacuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaauguauccuuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauaggaccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggccuaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugccuucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaaaaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuucuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaauaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccguggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6975 - RNA, 9876 nt, Artificial Sequence
  derived and/or modified CDS sequence (wt) from DENV-2__EU482464__SS-prME
ucggcaggcaugaucauuaugcugauuccaacagugauggcguuccaucuaaccacacgcaacggagaaccacacaugauugucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacgucuacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacgcuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaaggaaaaaucgugcaaccagaaaacuuggaauacaccauugugguaacaccucacucaggggaggagcaugcggucggaaaugacacaggaaaacacggcaaggaaaucaaaguaacgccacagaguuccaucacagaagcagaauugacagguuauggcaccgucacgauggaguguuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcgaagagaauggccauuuugggugacacagccugggacuuuggaucccugggaggaguguuuacaucuauaggaaaagcucuccaccaagucuuuggagcaaucuauggagcugccuucagugggguuucauggaccaugaaaauccucauaggagucauaaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaauuaugcaggcaggaaaacgaucuuugcggccucagcccacugagcuaaaguauucauggaaaacaugggguaaagcaaaaaugcucuccacagagucuuauaaccaaaccuuucucauugauggccccgagacgacagagugcccuaacacaaauagagcuuggaacucguuggagguugaagacuacggcuuuggaguguucaccaccaauauauggcuaaaauugaaagaaaaacaggaugcauucugugacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacacgaguaggaacgaaacaugcaauacuacuaguugcaguuucuuuugugacauugaucacagggaacauguccuucaaagaccuaggaagaguggugguuaugguaggcacuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaaucguacuccucucccaaaguaccauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuuuuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauacgugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccagucagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggacccaugccagugacccacucuagugcagcacaaagaagagggagaauaggaagaaauccaaaaaaugaaaaugaccaguacauauacaugggagaaccucuggaaaaugaugaagauugugcacacuggaaagaagccaaaaugcuccuagauaacauuaacacaccagaaggaaucauuccuaguauguuugaaccagagcgugaaaaaguggaugccauugauggcgaauaccgcuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauucuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggauuuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuacguuguaauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggagucccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccguugauggaauaacagugauugaucuagauccaauaccuuaugauccaaaguuugaaaagcaguugggacaaguaaugcuacuaauccucugcgugacucaaguacugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacugguaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuuuuucaucccgccagaaaagugugacacauuguugugugacauaggggagucaucaccaaaucccacaguggaagcaggacgaacacucagaguccuuaauuuaguagagaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaagaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauaccuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuuggcagcccuaaaugacaugggaaagauuagaaaagauauacaacaaugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccuggucuauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6976 - RNA, 9876 nt, Artificial Sequence
  derived and/or modified CDS sequence (wt) from DENV-2__EU482465__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaauaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucaucugcaaacacuccaugguagacagaggauggggaaauggauguggacuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacacuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacaguuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaguacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucauucauugagguaaaaaacugccacuggccaaaaucacacacccucuggaguaacggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggagggggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuagacuuuuccccuggaacgucaggaucuccaaucaucgacaaaaaaggaaaaguugugggucuuuaugguaaugguguugucacaaggaguggagcauaugugagugcuauagcccaaacugaaaaaagcacugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauucccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaagguggaugccauugauggcgaauaccguuugagaggagaagcaaggaaaacauuuguggacuugaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaccacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacguccugcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagagaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacgugagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaacugguugaacaacaacacucaauuuugcauaaaaguucucaacccauacaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucugcucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6977 - RNA, 9876 nt, Artificial Sequence
  derived and/or modified CDS sequence (wt) from DENV-2__EU482466__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacauguguacccucauggcuauggaucuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuaucaugacaggagacaucaaaggaaucaugcaggcaggaaaacgauccuugcggccucagcccacugagcugaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucugcggccauaaaagacaacagagccguccaugccgacauggguuacuggauagaaagugcacucaaugacacauggaagauagagaaagccucuuucauugagguaaaaaacugccacuggccgaaaucacacacccucuggaguaauggagugcuagaaagugagaugauaaucccaaagaaucucgcuggaccagugucucaacacaauuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacguugaucacagggaacauguccuucaaagaccuaggaagaguggugguuaugguaggcgccacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauuaacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucaccccuacccaugggaaaggcugaacuggaagauggagccuacagaaucaagcaaaaagggauucuuggguauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacaucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaauuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacaucucagaaaugggugccaauuucaaagcugagaggguuauagaccccagacgcugcaugaagccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggccacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauuaguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuugaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaacaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucguuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaacccuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacggucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6978 - RNA, 9876 nt, Artificial Sequence
  derived and/or modified CDS sequence (wt) from DENV-2__EU482467__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauauaccauugugguaacaccucacucaggggaggagcaugcggucggaaaugacacaggaaaacacggcaaggaaaucaaagugacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcuuuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacugguaggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucauucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuccccauaucaauaccaaucacggcagcagcaugguaccugugggaagugaagaaacaacgggccggaguauugugggacguuccuucaccuccacccaugggaaaggcugaacuggaagauggagccuacagaaucaagcaaaaagggauucuuggauauucucagaucggagcuggaguuuacaaagaaggaacuuuucauacaauguggcaugucacacguggugcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguauaucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaaucaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagauaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcaucgagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauaggaccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacaccaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagcccuagugagaaauccacucucacggaacuccacacaugagauguacuggguauccaaugcuucugggaacauagugucaucagugaacaugauuucaaggauguugaucaauagauucacaaugagacacaagaaagccacuuacgagccggacguugaccucggaagcggaacccgaaacauuggaauugaaagugaaauaccaaacuuagacauaauugggaaaagaauagaaaaaauaaagcaagagcaugaaacaucauggcacuacgaccaagaccauccauacaaaacaugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggcaauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagacuuaaaaaaugaagaaaugguaacaaaccacauggaaggagaacacaggaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccaccaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagaucagaaaagauauacaacagugggaaccuucaaaaggauggaacgauuggacacaagugcccuucuguucacaccauuuucaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccguacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6979 - RNA, 9876 nt, Artificial Sequence
  derived and/or modified CDS sequence (wt) from DENV-2__EU482468__SS-prME
ucugcagguaugaucauuaugcugauuccaacagugauggcguuccaucuaaccacacgcaacggagaaccacacaugaucgucgguauacaggagaaagggaaaagucuacuguucaaaacagaggauggugugaacaugugcacccucauggccauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggaucaugagacauccaggcuucaccauaauggcagcgauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaaccuagccuaaaagaagagcaggacaagagguucgucugcaaacacuccaugguagacagaggauggggaaauggauguggauuauuuggaaagggaggcauugugaccugugcuauguucacaugcaaaaagaacauggaagggaaaaucgugcagccagaaaacuuggaauacaccauugugguaacaccucacucaggggaggagcaugcggucggaaaugacacaggaaaacacggcaaggaaaucaaaguaacaccacagaguuccaucacagaagcagaauugacagguuaugguaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacggucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucagaggaaucaugcaggcaggaaaacgaucuuugcggccucagccuacugagcugaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauggaaagugcacucaaugacacauggaagauagagaaagccucuuucauugaaguaaaaaacugccauuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggaccuucuuugagaacaacuacugccucuggcaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagccggacuacucuugagaaagcugaccuccaaggaauuaaugaugacuaccauaggaauuguacuccuuucccaaaguacuauaccagagaccguucuugaauugacugaugcguuagcccuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauacccuuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggauguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauugaucuuggcccccacuagaguuguggcagcugaaauggaggaagcucucagaggacuuccaauaagauaccaaaccccagccaucagagcugagcacacugggcgggaaauuguggaccuaaugugucaugccacauuuaccaugaggcugcuaucaccaguuagagugccaaacuauaacuugauuaucauggacgaagcccauuucacagacccagcaaguauagcggcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaagguggugcuuugauggaauaaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucuuugacccugaaccuaaucacagaaauggguaggcuuccaacauucaugacucagaagacaagagacgcacuggauaaccuagcagugcugcacacagcugaagcagguggaagggcguacaaucaugcucucagugaacugccggagacccuagagacacugcuuuuacugacacuucuggcuacaguuacaggagggaucuuuuuauucuugaugagcgggaggggcauagggaagaugacccugggaaugugcugcauaaucacggcuagcacccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucucuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcccugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggacguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuucccacggugacacagauggcaaugacagacacgacuccguuuggacaacagcguguuuuuaaagaaaaaguggacacgagaacccaggaaccgaaagaaggcacgaagaaacuaaugaaaaucacagcagaguggcuguggaaagaacuagggaagaaaaagacuccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaagaaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcuacacaagcuagguuacauucuaagagacgugagcaaaaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaauaagguggugcgugugcaaagaccaacaccaagaggcacaguaauggacaucauaucgagaagagaccaaagagguagugggcaaguugguaccuauggacucaauaccuucaccaauauggaagcccaauuaaucagacagauggagggagaaggagucuuuaaaaacauccagcaccugacagucacagaagaaguugccgugcauaacugguuggcaagaguggggcgcgaaagguuaucaagaauggccaucaguggagaugauuguguugugaaaccuuuagaugacagguucgcaaacgcuuugacagcccuaaaugacaugggaaagauuaggaaagauauacaacaaugggaaccuucaaaaggauggaacgauuggacacaagugcccuucuguucacaccauuuucaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcaguaccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6980 - RNA, 9876 nt, Artificial Sequence
  derived and/or modified CDS sequence (wt) from DENV-2__EU482469__SS-prME
ucugcaggcaugaucauuaugcugauuccaacaguaauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaaccuggauccugagacauccaggcuucaccauaauggcagcaauccuggcacacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagauucgucugcaaacacuccaugguagacagaggauggggaaauggauguggauuauuuggaaagggaggcaucgugaccugugcuauguucacaugcaaaaagaacauggaagggaaaaucgugcaaccagagaacuuggaauacaccauugugguaacaccucacucaggggaggagcaugcggucggaaaugacacaggaaaacacggcauggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauugguuacuuucaaaaauccccaugcgaagaaacaggauguuguuguuuuaggaucccaagaaggggccaugcauacagcacucacaggagccacagaaauccaaaugucaucaggaaacuugcucuucacuggacaucucaagugcaggcugagaauggacaagcuacagcuuaaaggaaugucauacuccaugugcacaggaaaguuuaaagucgugaaggaaauagcagaaacacaacauggaacgauagucaucagagugcaauaugaaggggacggcucuccauguaaaaucccuuuugagauaauggaucuggaaaaaagauaugucuuaggccgccuaaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccaucuugggugacacagccugggacuucggaucccugggaggaguguuuacaucuauaggaaaagcucuccaccaagucuuuggagcaaucuauggagcugccuucagugggguuucauggaccaugaaaauccucauaggagucaucaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauuaaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcgggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauauagaggugaggaugggugcugguacgggauggaaaucagaccguugaaagagaaagaagaaaaccugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagagugguggucaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaacuaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguaguaugucgauaaaaaaugaagaggaagaacaaacacugaccauacucauuagaacaggacugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaaacauugaagacaaccccgagaucgaagaugacauuuuccgaaagagaagacugaccaucauggaccuccacccaggagcgggaaagacgaaaagauaccuuccagccauagucagagaagccauaaaacggggucugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaggaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagaccuuagagacacugcuuuuauugacacuucuggccacagucacaggagggaucuuuuuauucuugaugagcgggaggggcauagggaagaugacccuggggaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggccacaacauucguuacaccaaugcugagacacagcauugagaauuccucagugaauguaucccuaacagcuauagccaaccaagcaacaguguuaaugggucuagggaaaggauggccauugucaaagauggacaucggaguuccucuucucgccauuggauguuacucacaagucaauccuauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacacaggagagacgcuuggagagaaauggaaaagccgauugaacgcacugggaaaaagugaauuccagaucuacaagaaaaguggaauccaagaaguggauaggaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauacggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacgucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccaaaagaaggcacgaagaaacuaaugaaaaucacagcagaguggcuguggaaagaauuagggaagaaaaagacaccuaggaugugcaccagagaagaauucacaaaaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaaggugguacgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguauacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauucaagcagcaauaaaucagguuagaucucuuauaggcaaugaggaauacacagauuacaugccauccaugaaaagauucagaagagaagaggaagaagcaggaguccugugguaa

SEQ ID NO: 6981 - RNA, 9876 nt, Artificial Sequence
  derived and/or modified CDS sequence (wt) from DENV-2__EU482470__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacauacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagucuugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucgaaacuagcuucagcuauccagaaagcccaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucgaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuucgauuucugcgauggaacuacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuucucacugggagucuugggaauggcauuguuccuggaagaaaugcuuaggacccgaguaggaacgaaacaugcaauacuacuaguugcaguuucuuuugugacauugaucacagggaacauguccuucaaagaccuaggaagaguggugguuaugguaggcgccacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucaugacuaucuugugcgucccaaacgcagugauauuacaaaaugcauggaaagugaguugcacaauacuggcagugguguccguuuccccacugcuuuugacauccucacggcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaggaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuauuauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucguggucacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaauauuaacacaccagaaggaauuauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaauuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacgccccaagacaaccaauugaccuacguugucauagccauccucacagugguggccgcaaccauggcaaacgagauggguuuccuagaaaaaacgaagaaggaucuuggauugggaagcauugcaacccagcaacccgagagcaacauccuggacauagaccuacgcccugcaucagcuuggacguuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuucagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaccuggugcgucuucagaguggaguugacgucuucuucaucccgccagaaaagugugacacauuguugugugacauaggggagucaucgccaaaucccacaguggaagcaggacgaacacucagaguccuuaaucuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguggguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacuuaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauucaagcagcaauaaaucagguuagaucucuuauaggcaaugaggaauacacagauuacaugccauccaugaaaagauucagaagagaagaggaagaagcaggaguccugugguaa

SEQ ID NO: 6982 - RNA, 9876 nt, Artificial Sequence
  derived and/or modified CDS sequence (wt) from DENV-2__EU482471__SS-prME
ucugcaggcaugaucauuaugcugauuccaacaguaauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuucguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggagaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagagaacuuggaauacaccauugugguaacaccucacucaggggaggagcauucggucggaaaugacacaggaaaacacggcauggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauugguuacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggaucuggaaaaaagauaugucuuaggccgccuaaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggaguuaucaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauuaaaucacauucuagcagaaaaugaggugaaguugacuauuaugacaggagacaucagaggaaucaugcaggcaggaaaacgauccuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcgggaccauggcaccuagguaagcuugagauggacuuugauuucugcgauggaaccacagugauagugacugaggacugcggaaacagaggacccucuuugagaacaacuacugccucuggaaaacucauaacagaauggugcugccgaucuugcacauuaccaccccuaagauauagaggugaggaugggugcugguacgggauggaaaucagaccguugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagagugguggucaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcgcuagccuuagguaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccaaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccagguguuggcacuggagccuggaaaaaauccaagagccguccaaacgaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagcuauagucagagaagccauaaaacggggucugagaacauuaaucuuggcccccacuagaguuguggcagcugaaauggaggaagcucuuagaggacuuccaauaagauaccaaaccccagccaucagagcugagcacacugggcgggaaauuguggaucuaaugugucaugccacauuuaccaugaggcugcuaucaccaguuagagugccaaacuauaacuugaucaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaggaaggggaaaggaagaaauugaaacccagaugguuggaugcuaggaucuacucugacccacuagcgcuaaaagaguucaaagaauuugcagccggaagaaagucucugacccugaaccuaaucacagaaauggguaggcuuccaacauucaugacucagaagacaagagacgcacuggauaaccuagcagugcugcacacggcugaagcagguggaagggcguacaaucaugcucucagugaacugccggagaccuuagagacacugcuuuuacugacacuucuggccacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaauguaucccuaacagcuauagccaaccaagcaacaguguuaaugggucuagggaaaggauggccauugucaaagauggacaucggaguuccccuucucgccauuggauguuacucacaagucaauccuauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaagaaguggauaggaccuuagcaaaagaaggcaucaaaagaggagaaacggaccaucacgcugugucgcgaggcucagcaaaacugagaugguucguugagagaaacauggucacaccagaagggaaaguaguggaccucgguuguggcaggggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauaguaucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacgucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccaaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacauuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguauacuuguuguuccauguagaaaccaagaugaacugauuggcagagcccgaaucucccaaggagcaggguggucuuugcgggagacggccuguuuggggaagucuuacgcccaaauguggagccugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6983 - RNA, 9876 nt, Artificial Sequence
  derived and/or modified CDS sequence (wt) from DENV-2__EU482472__SS-prME
ucugcaggcaugaucauuaugcugauuccaacagugauggcguuccaucuaaccacacgcaacggagaaccacacaugaucgucggcauacaggagaaagggaaaagucuucuguucaaaacagaggauggugugaacaugugcacccucauggccauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcagccagaaaacuuggaauacaccauugugguaacaccucacucaggggaggagcaugcggucggaaaugacacaggaaaacacggcaaggaaaucaaaguaacaccacagaguuccaucacagaagcagaauugacagguuaugguaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuucggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauggaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggaccuucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccuuucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauacccuuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaauaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaagguggugcuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucuuugacccugaaccuaaucacagaaauggguaggcuuccaacauucaugacucagaagacaagagacgcacuggauaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucuuacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgguugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauaccuucaccaauauggaagcccaauuaaucagacagauggagggagaaggagucuuuaaaaacauccagcaccugacagucacagaagaaguugccgugcauaacugguuggcaagaguggggcgcgaaagguuaucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6984 - RNA, 9876 nt, Artificial Sequence
  derived and/or modified CDS sequence (wt) from DENV-2__EU482473__SS-prME
ucugcaggcaugaucauuaugcugauuccaacagugauggcguuccaucuaaccacacgcaacggagaaccacacaugaucgucgguauacaggagaaagggaaaagucuuuuguucaaaacagaggauggugugaacaugugcacccucauggcuauggaccuuggugaauugugugaagacacgaucacguacaaguguccucuucucaggcagaaugagccagaagacauagacugcuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguuuaagaaaggaaguucuaucggccaaauguuugagacaacgaugagaggggcgaagagaauggccauuuugggugacacagccugggacuuuggaucccuaggaggaguguuuacaucuauaggaaaagcccuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggggacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagcuuacagaaucaagcaaaaagggauucuuggauauucucagaucggagcuggaguuuacaaagaaggaacuuuucauacaauguggcacgucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaaccaacaccggaacaauaggugcuguaucucuggacuuuuccccuggaacgucaggaucuccaaucaucgacagaaaaggaaaaguugugggucuuuaugguaaugguguugucacaaggaguggagcauaugugagugccauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccauuagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacuccuccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccgucugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaauuacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaacccuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuuacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaacaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaagagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugccuuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaaguagcaauaaaucagguuagaucucuuauaggcaaugaggaauacacagauuacaugccauccaugaaaagauucagaagagaagaggaagaagcaggaguccugugguaa

SEQ ID NO: 6985 - RNA, 9876 nt, Artificial Sequence
  derived and/or modified CDS sequence (wt) from DENV-2__EU482474__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagggaaaaaagaucaguggcacucgucccacaugugggaaugggacuggagacgcgaaccgaaacauggaugucaucagaaggggcuuggaaacaugcccagagaauagaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguugggucgacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccggugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaagugacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggacuuggaaaaaagauaugucuuaggccgccugaucacagucaacccaauuguaacagaaaaagauagcccaaucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaauucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucucacaaccaaaccuuucucauugauggccccgagacggcagagugccccaacacaaauagagcuuggaacucguuggagguugaagacuacggcuuuggaguguuuaccaccaauauauggcuaagauugaaagaaaaacaggaugcauucugcgacucaaaacuuaugucggcggccauaaaagacaacagagccguccaugcugacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaucauacacaaauagcaggaccauggcaccuagguaagcuugagauggacuuugauuucugcgauggaaccacagugauagugacugaggacugcggaaauagaggaccuucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuuggggauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauagugagaaacauggaaaaguaucaauuagcagugacuaucauggcuaucuugugugucccaaacgcagugauauuacaaaaugcauggaaagugaguugcacaauacuggcaguggugucuguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcaguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggagcggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagagggcuuccaauaagauaccaaaccccagccaucagagcugagcacacuggacgggaaauuguggaucuaaugugucaugccacauuuacaaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaaguauaaaagcaggaaaugauauagcagcuugccugagaaaaaauggaaagaaaguaauacaacuuagcaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgagaaaaaguggaugccguugauggcgaauaccguuugagaggagaagcaaggaaaaccuuuguggacuuaaugaggagaggagacuuaccagucuggcuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauagucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucucggauuaggaagcauugcaacccagcaacccgagagcaacauccuggacauagaccuacgucccgcaucagcuuggacgcuguaugccguggcuacaacauucguuacaccaaugcugagacauaguauugagaauuccucagugaauguaucccuaacagccauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaacugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaauaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaagguagcagagccauaugguacauguggcuuggagcucgcuuccuggaguuugaagcccuaggauuccugaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaagcuaacguaucaaaacaagguggugcgugugcaaagaccaacaccaagaggaacaguaauggacaucauaucgagaagagaccaaagagguagugggcaaguugguaccuauggacucaacacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaauugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaguggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6986 - RNA, 9876 nt, Artificial Sequence
  derived and/or modified CDS sequence (wt) from DENV-2__EU482475__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguauugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggaaugcuccccgagaacaggccucgacuucaaugagaugguguugcuucagauggaaaauaaagcuuggcuggugcauaggcaaugguuucuagaccugccauuaccauggcugcccggagcggacaaacaagagucaaauuggauacagaaagaaacauuggucacuuuuaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucauucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuauuauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucgauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggagggggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucuuuggacuuuuccccuggaacgucaggaucuccaaucaucgacaaaaaaggaaaaguugugggucucuaugguaaugguguugucacaaggaguggagcauaugugagugcuauagcccaaacugaaaaaagcauugaagauaaccccgagaucgaagaugacauuuuccgaaagagaagacugaccaucauggaccuccacccaggagcgggaaagacgaaaagauaccuuccagccauagucagagaagccauaaaacggggauugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaauuauuccuaguauguuugaaccagagcgugaaaagguggaugccauugauggcgaauaccguuugagaggagaagcaaggaaaacauuuguggacuuaaugaggagaggagacuuaccagucugguuggcuuacaaaguggcagcugaaggcaucaacuauguagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauacuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuggauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagagaaguggaauccaggaaguggauagaaccuuagcaaaagaaggcaucaaaagaggagagacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacaugaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggacguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauagcagguuuugggagcugguugacaaggaaaggaaucuccaucuugaaggaaagugugagacauguguguacaacaugaugggaaaaagagaaaagaagcuaggggaauucggcaaggcaaaagguagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacaugaaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6987 - RNA, 9876 nt, Artificial Sequence
  derived and/or modified CDS sequence (wt) from DENV-2__EU482541__SS-prME
ucugcaggcaugaucauuaugcugauuccaacaguaauggcguuccaucuaaccacacgcaacggagaaccacacaugaucgucgguauacaggagaaagggaaaagucuucuguucaaaacagaggauggugugaauaugugcacccucauggcuauggaccuuggugaauugugugaagacacaaucacguacaaguguccucuucucaggcagaaugagccagaagauauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucacuauaauggcagcaauccuggcguacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagagaacuuggaauacaccauugugguaacaccucacucaggggaggagcaugcggucggaaaugacacaggaaaacacggcauggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauugguuacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggaucuggaaaaaagauaugucuuaggccgccuaaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggauccuugggaggaguguuuacaucuauaggaaaagcucuccaccaagucuuuggagcaaucuauggagcugccuucagugggguuucauggaccaugaaaauccucauaggagucaucaucacauggauaggaaugaacucacgcagcaccucacugucugugucacuaguacuggugggaauugugacacuguauuugggagucauggugcaggccgauagugguugcgucgugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauuaaaucacauucuagcagaaaaugaagugaaguugacuauuaugacaggagacaucagaggaaucaugcaggcaggaaaacgaucuuugcggccucagcccgcugagcuaaaguauucauggaaaacaugggguaaagcaaaaaugcucuccacagaaucuuauaaccaaaccuuucucauugauggccccgagacggcagagugccccaacacaaauagagcuuggaacucguuggagguugaagacuacggcuuuggaguguucaccaccaacauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuacagaccaggcuaccauacacaaauagcgggaccauggcaccuagguaagcuugagauggacuuugauuucugugauggaaccacagugauagugacugaggacugcggaaauagaggacccucuuugagaacaacuacugccucuggaaaacucauaacagaauggugcugccgaucuugcacauuaccaccccuaagauauagaggugaggaugggugcugguacgggauggaaaucagaccguugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauagguaugggcgugacuuaucuugcccuauuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgaccuggaacuggagagagcaaccgaugucaaaugggaagaccaggcagagauaucaggaagcaguccaauccugucaauaacaauaucagaagaugguaguaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacggggucugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaggaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucuuagugaacugccggagaccuuagagacacugcuuuuacugacacuucuggccacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaauguaucccuaacagcuauagccaaccaagcaacaguguuaaugggucuagggaaaggauggccauugucaaagauggacaucggaguuccccuucucgccauuggauguuacucacaagucaauccuauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaagaaguggauaggaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucuggaaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacgucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccaaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaucuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcgccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuucaugagcuaaucaugaaggauggucguauacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauuuagaagagaagaggaagaagcaggaguccugugguaa

SEQ ID NO: 6988 - RNA, 9876 nt, Artificial Sequence
  derived and/or modified CDS sequence (wt) from DENV-2__EU482542__SS-prME
ucugcaggcaugaucauuauguugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucuuaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuuugaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuguuuggaaagggaggcauugugaccugugcuauguucacaugcaaaaagaacauggaagggaaaaucgugcaaccagaaaauuuggaauacaccauugugguaacaccucacucaggggaggagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcaaauggaaaauaaagcuuggcuggugcauaggcaaugguuucuagaccugccauuaccauggcugcccggagcggauaaacaagagucaaauuggauacagaaagagacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguucaaaguugugaaggaaauagcagaaacacaacauggaacgauagucaucagagugcaauaugaaggggacggcucuccauguaaagucccuuuugagauaauggauuuggaaaaaagauacgucuuaggccgccugaucacagucaacccaauuguaacagaaaaagacagcccagucaacauagaagcagaaccuccauucggagacaguuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugcuuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaguacaaguuccaaccagaauccccuucaaaacuagcuucagcuauccagaaagcucaagaagagggaacuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucuaguuaacuccuuggucacagccggacaugggcagguugacaauuuuucacugggagucuugggaauggcauuguuccuggaggaaaugcuuaagacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuuuaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccuaucaauaacaauaucagaagaugguagcaugucgauaaaaaacgaagaggaagaacaaacacugaccauacucauuagaacaggauugcugguaaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagcccggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauaguaagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagcuacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugagaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaagggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuaccuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacgugagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagauauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagacuuaaaaaaugaagaaaugguaacaaaccacauggaaggagaacacaagaaauuggccgaggccauuuucaaacuaacguaucaaaacaagguggugcgugugcaaagaccaacgccaagaggaacaguaauggacaucauaucgagaagagaccaaagagguagugggcaaguugguaccuauggacucaauacuuuuaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagacauacaacagugggaaccuucaaaaggauggaacgauuggacacaagugcccuucuguucacaccauuuccaugagcuaaucaugaaggauggucguauacuuguuguuccauguagaaaccaagaugaacugauuggcagagcccgaaucucccaaggagcaggguggucuuugcgggagacggccuguuuggggaagucuuacgcucaaauguggagcuugauguacuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaacuccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguccugugguaa

SEQ ID NO: 6989 - RNA, 9876 nt, Artificial Sequence
  derived and/or modified CDS sequence (wt) from DENV-2__JX966380__SS-prME
acugcaggcaugaucaucaugcugauuccaacagugauggcguuucaucugaccacacgcaacggagaaccacacaugaucgucaguagacaagaaaaagggaaaagccuucuguuuaagacaaaggacggcacgaacauguguacccucauggccauggaccuuggugaguugugugaagacacaaucacguauaaauguccuuuucucaagcagaacgaaccagaagacauagauuguuggugcaacuccacguccacauggguaacuuaugggacauguaccaccacaggagagcacagaagagaaaaaagaucaguggcgcuuguuccacacgugggaaugggauuggagacacgaacugaaacauggaugucaucagaaggggccuggaaacaugcccagagaauugaaacuuggauucugagacauccaggcuuuaccauaauggccgcaauccuggcauacaccauaggaacgacgcauuuccaaagaguccugauauucauccuacugacagccaucgcuccuucaaugacaaugcgcugcauaggaauaucaaauagggacuuuguggaaggagugucaggagggaguuggguugacauaguuuuagaacauggaaguugugugacgacgauggcaaaaaauaaaccaacacuggacuuugaacugauaaaaacagaagccaaacaacccgccaccuuaaggaaguacuguauagaggcuaaacugaccaacacgacaacagacucgcgcugcccaacacaaggggaacccacccugaaugaagagcaggacaaaagguuugucugcaaacauuccaugguagacagaggauggggaaauggauguggauuauuuggaaaaggaggcaucgugaccugugcuauguucacaugcaaaaagaacauggaaggaaaaauugugcagccagaaaaccuggaauacacugucgugauaacaccucauucaggggaagaacaugcagucggaaaugacacaggaaaacaugguaaagaagucaagauaacaccacagagcuccaucacagaggcggaacugacaggcuauggcacuguuacgauggagugcucuccaagaacgggccucgacuucaaugagaugguguugcugcaaaugaaagacaaagcuuggcuggugcacagacaaugguuccuagaccuaccguugccauggcugcccggagcagacacacaaggaucaaauuggauacagaaagagacacuggucaccuucaaaaauccccaugcgaaaaaacaggauguuguugucuuaggaucccaagagggggccaugcauacagcacucacaggggcuacggaaauccagaugucaucaggaaaccugcuguucacaggacaucucaagugcaggcugagaauggacaaauuacaacuuaaagggaugucauacuccaugugcacaggaaaguuuaaaauugugaaggaaauagcagaaacacaacauggaacaauagucauuagaguacaauaugaaggagacggcucuccaugcaagauccccuuugagauaauggaucuggaaaaaagacauguuuugggccgccugaucacagucaacccaauuguaacagaaaaggacaguccagucaacauagaagcagaaccuccauucggagacagcuacaucaucauaggaguggaaccaggacaauugaagcuggacugguucaagaaaggaaguuccaucggccaaauguuugagacaacaaugaggggagcgaaaagaauggccauuuugggcgacacagccugggauuuuggaucucugggaggaguguucacaucaauaggaaaggcucuccaccagguuuuuggagcaaucuacggggcugcuuucaguggggucucauggacuaugaagauccucauaggaguuaucaucacauggauaggaaugaacucacguagcacaucacugucugugucacugguauuagugggaaucgugacacuguacuugggaguuauggugcaggccgauagugguugcguugugagcuggaagaacaaagaacuaaaauguggcaguggaauauucgucacagauaacgugcauacauggacagaacaauacaaguuccaaccagaauccccuucaaaacuggcuucagccauccagaaagcucaugaagagggcaucuguggaauccgcucaguaacaagacuggaaaaucuuauguggaaacagauaacaucagaauugaaucauauucuaucagaaaaugaagugaaacugaccaucaugacaggagacaucaaaggaaucaugcagguaggaaaacgaucucugcggccucaacccacugaguugagguauucauggaaaacaugggguaaagcgaaaacgcucuccacagaacuccacaaucagaccuuccucauugauggucccgaaacagcagaaugccccaacacaaacagagcuuggaauucacuagaaguugaggacuacggcuuuggaguauucacuaccaauauauggcuaagauugagagaaaagcaggauguauuuugugacucaaaacucaugucagcggccauaaaggacaacagagccguccaugcugauauggguuauuggauagaaagcgcacucaaugauacauggaagauagagaaagcuucuuucauugaagucaaaaguugccacuggccaaagucacacacucuauggaguaauggagugcuagaaagcgagaugguaauuccaaagaauuucgcuggaccagugucacaacauaauaacagaccaggcuaucacacacaaacagcaggaccuuggcaucuaggcaagcuugagauggacuuugauuucugcgaagggacuacaguggugguaaccgaggacuguggaaacagagggccuucuuuaagaacaaccacugccucaggaaaacucauaacggaaugguguugucgaucuugcacacuaccaccacuaagauacagaggugaggauggaugcugguacgggauggaaaucagaccauugaaagagaaagaagaaaaucuggucaguucucuggucacagccggacaugggcagauugauaauuucucauuaggaaucuugggaauggcacuguuccuugaagaaaugcucaggacucgaguaggaacgaaacaugcaauauuacuagucgcaguuucuuucguaacguuaaucacagggaacaugucuuuuagagaccugggaagagugaugguuauggugggugccaccaugacagaugacauaggcaugggugugacuuaucuugcucuacuagcagcuuucaaagucagaccaaccuuuacagcuggacugcucuugagaaaacugaccuccaaggaauuaaugaugaccaccauaggaaucguucuucucucccagaguagcauaccagagaccauucuugaacugaccgaugcguuagcuuuaggcaugaugguccucaagauggugagaaacauggaaaaauaucagcuggcagugacuaucauggcuauuuugugcgucccaaaugcugugauauuacagaacgcauggaaagugaguugcacaauauuggcaguggugucuguuuccccccugcucuuaacauccucacaacagaaagcggacuggauaccauuagcguugacgaucaaaggccucaauccaacagccauuuuucuaacaacccucucaagaaccagcaagaaaaggagcuggccuuuaaaugaggccaucauggcgguugggauggugaguaucuuggccagcucucucuuaaagaaugacauccccaugacaggaccauuaguggcuggagggcuucuuacugugugcuacguacuaacugggcggucagccgaucuggaacuagagagagcuaccgaugucaaaugggaugaccaggcagagauaucagguagcaguccaauucugucaauaacaauaucagaagauggcagcaugucaauaaagaaugaagaggaagagcaaacacugacuauacucauuagaacaggauugcuugugaucucaggacucuuuccgguaucaauaccaaucacagcagcagcaugguaccugugggaaguaaagaaacaacgggcuggaguguugugggauguccccucaccaccacccgugggaaaggcugaauuggaagauggagccuacagaaucaagcaaaaaggaauccuuggauauucccagaucggagcuggaguuuacaaagaaggaacauuucacacaauguggcacgucacacguggcgcuguccuaaugcauaaggggaagaggauugaaccaucaugggcggacgucaagaaagacuuaauaucauauggaggagguuggaagcuagaaggagaauggaaagaaggagaagaaguccaggucuuggcauuggagccugggaaaaauccaagagccguccaaacaaaaccuggccuuuuuagaaccaauacuggaaccauaggugccguaucucuggacuuuuccccugggacgucaggaucuccaaucgucgacaaaaaaggaaaaguuguaggucucuauggcaauggugucguuacaaggaguggagcauaugugagugccauagcucagacugaaaaaagcauugaagacaauccagagauugaagaugacaucuuucgaaagagaagauugaccaucauggaucuccacccaggagcaggaaagacaaagagauaccucccggccauagucagagaggccauaaaaagaggcuugagaacacuaauccuagcccccacuagagucguggcagcugaaauggaggaagcccuuagaggacuuccaauaagauaccaaacuccagcuaucagggcugagcacaccgggcgggagauuguggacuuaaugugucaugccacauuuaccaugaggcugcuaucaccaaucagggugccaaauuacaaccugaucaucauggacgaagcccauuuuacagauccagcaagcauagcagcuaggggauacaucucaacucgaguggagaugggugaggcagcuggaauuuuuaugacagccacuccuccggguagcagagauccauuuccucagaguaaugcaccaauuauggacgaagaaagagaaauuccggaacguucauggaacuccgggcacgagugggucacggauuuuaaaggaaagacugucugguuuguuccaagcauaaaaaccggaaaugacauagcagccugccugagaaagaauggaaagagggugauacaacucaguaggaagaccuuugauucugaauaugucaagacuagaaccaaugacugggauuucgugguuacaacugacaucucggaaaugggugccaacuuuaaagcugagaggguuauagaccccagacgcugcaugaaaccaguuauacugacagacggcgaagagcgggugauucuggcaggacccaugccagugacccacucuagugcagcacaaagaagagggagaauaggaaggaauccaaggaaugaaaaugaucaauauauauauaugggggaaccccuggaaaaugaugaagacugugcgcacuggaaggaagcuaagaugcuccuagauaacaucaacacaccugaaggaaucauucccagcauguucgagccagagcgugaaaagguggaugccauugacggugaauaucgcuugagaggagaagcacggaaaacuuuuguggaccuaaugagaagaggagaccuaccagucugguuggcuuauaaaguggcagcugaagguaucaacuacgcagacagaagaugguguuuugacggaaccagaaacaaucaaaucuuggaagaaaauguggaaguggaaaucuggacaaaggaaggggaaaggaaaaaauugaaaccuagaugguuagaugcuaggaucuacuccgacccacuggcgcuaaaagaauucaaggaauucgcagccggaagaaagucccuaacccugaaccuaaucacagagaugggcagacucccaacuuuuaugacucagaaggccagagaugcacuagacaacuuggcggugcugcacacggcugaagcggguggaaaggcauacaaucaugcucucagugaacuaccggagacccuggagacauugcuuuugcugacacuguuggccacagucacgggaggaaucuuucuauuccugaugagcggaagggguauagggaagaugacccugggaaugugcugcauaaucacggccagcauccucuuaugguaugcacaaauacaaccacauuggauagcagcuucaauaauauuggaguucuuucucauagucuugcucauuccagaaccagaaaagcagaggacaccccaggauaaucaauugacuuaugucaucauagccauccucacagugguggccgcaaccauggcaaacgaaauggguuuucuggaaaaaacaaagaaagaccucggacugggaaacauugcaacucagcaaccugagagcaacauucuggacauagaucuacguccugcaucagcauggacguuguaugccguggcuacaacauuuaucacaccaauguugagacauagcauugaaaauuccucaguaaaugugucccuaacagccauagcuaaccaagccacagugcuaaugggucucgggaaaggauggccauugucaaagauggacauuggaguuccccuccuugcuauuggguguuacucacaagucaacccuauaacccucacagcggcucuucuuuuauugguagcacauuaugccaucauaggaccgggacuucaagccaaagcaaccagagaagcucagaaaagagcagcagcgggcaucaugaaaaacccaacuguggauggaauaacagugauagaucuagauccaauacccuaugauccaaaguuugaaaagcaguugggacaaguaaugcuccuaguccuuugcgugacccaagugcugaugaugaggacuacgugggcuuugugugaagccuuaacucuagcaaccggacccguguccacauugugggaaggaaauccagggagauucuggaacacaaccauugcagugucaauggcaaacaucuuuagagggaguuaccuggcuggagcuggacuucucuuuucuaucaugaagaacacaaccagcacgagaagaggaacuggcaacauaggagaaacgcuaggagagaaauggaaaagcagacugaacgcauuggggaaaagugaauuccagaucuacaaaaaaaguggaauucaagaaguggacagaaccuuagcaaaagaaggcauuaaaagaggagaaacggaucaucacgcugugucgcgaggcucagcaaaacugagaugguucguugaaagaaauuuggucacaccagaagggaaaguaguggaccuugguugcgguagagggggcuggucauacuauuguggaggauuaaagaauguaagagaaguuaaaggcuuaacaaaaggaggaccaggacacgaagaaccuaucccuaugucaacauauggguggaaucuaguacgcuuacagagcggaguugacgucuuuuuuguuccaccagagaagugugacacauuguugugugacauaggggaaucaucaccaaaucccacgguagaagcgggacgaacacucagaguccuuaaccuaguggaaaauuggcugaacaauaacacccaauuuugcguaaagguucuuaacccguacaugcccucagucauugaaagaauggaaaccuuacaacggaaauacggaggagccuuggugagaaauccacucucacggaauuccacacaugagauguacuggguguccaaugcuuccgggaacauagugucaucagugaacaugauuucaagaaugcugauuaacagauucaccaugagacacaagaaggccaccuaugagccagaugucgaccucggaagcggaacccgcaauauuggaauugaaagugagacaccgaaccuagacauaauugggaaaagaauagaaaaaauaaaacaagagcaugaaacgucauggcacuaugaccaagaccacccauacaaaacaugggcuuaccauggcagcuaugaaacaaaacagacuggaucagcaucauccauggugaacggaguagucagauugcugacaaaacccugggacguuguuccaauggugacacagauggcaaugacagacacaacuccuuucggacaacagcgcgucuucaaagagaagguggauacgagaacccaagaaccaaaagaaggcacaaaaaaacuaaugaaaaucacggcagaguggcucuggaaagaacuaggaaagaaaaagacaccuagaaugugcaccagagaagaauucacaaaaaaggugagaagcaaugcagccuugggggccauauuuaccgaugagaacaaguggaaaucggcgcgugaggcuguugaagauaguagguuuugggagcugguugacaaggaaagaaaccuccaucuugaagggaaaugugaaacauguguauacaacaugaugggaaaaagagagaaaaaacuaggagaguuugguaaagcaaaaggcagcagagccauaugguacauguggcucggagcacgcuucuuagaguuugaagcccuaggauuuuugaaugaagaccauugguucuccagagagaacucccugaguggaguggaaggagaagggcugcauaagcuagguuacaucuuaagagaggugagcaagaaagaaggaggagcaauguaugccgaugacaccgcaggcugggacacaagaaucacaauagaggauuuaaaaaaugaagaaaugauaacgaaccacauggcaggagaacacaagaaacuugccgaggccauuuuuaaauugacguaccaaaacaagguggugcgugugcaaagaccaacaccaagaggcacaguaauggacaucauaucgagaagagaccaaagggguaguggacaaguuggcaccuauggccucaacacuuucaccaacauggaagcacaacuaauuaggcaaauggagggggaaggaaucuucaaaaacauccagcacuugacagccucagaagaaaucgcugugcaagauuggcuaguaagaguagggcgugaaagguugucaagaauggccaucaguggagaugauuguguugugaaaccuuuagaugauagauuugcaagagcucuaacagcucuaaaugacaugggaaagguuaggaaggacauacagcaaugggagcccucaagaggauggaacgacuggacacaggugcccuucuguucacaccauuuucacgaguuaauuaugaaagauggucgcacacucguaguuccaugcagaaaccaagaugaauugaucggcagagcccgaauuucccagggagcuggguggucuuuacgggagacggccuguuuggggaagucuuacgcccaaauguggagcuugauguacuuccacagacgugaucucaggcuagcggcaaaugccaucugcucggcagucccgucacacuggguuccaacaagccggacaaccugguccauacacgccagccaugaauggaugacgacggaagacauguugacaguuuggaacaaaguauggauccuagaaaauccauggauggaagacaaaacuccaguggaaucaugggaggaaaucccauaccugggaaaaagagaagaccaauggugcggcucacugauugggcugacaagcagagccaccugggcgaagaauauccagacagcaauaaaccaagucagaucccucauuggcaaugaggaauacacagauuacaugccauccaugaaaagauucagaagagaagaggaagaggcaggaguuuugugguag

SEQ ID NO: 6990 - RNA, 9876 nt, Artificial Sequence
  derived and/or modified CDS sequence (wt) from DENV-2__JX966379__SS-prME
acugcaggcaugaucaucaugcugauuccaacagugauggcguuucaucugaccacacgcaacggagaaccacacaugaucgucaguagacaagaaaaagggaaaagccuucuguuuaagacaaaggauggcacgaacauguguacucucauggccauggaccuuggugaguugugugaagacacaaucacguauaaauguccuuuucucaagcagaacgaaccagaagacauagauuguuggugcaacuccacguccacauggguaacuuacggaacauguaccaccacaggagagcacagaagaggaaaaagaucaguggcgcuuguuccacacgugggaaugggauuggagacacgaacugaaacauggaugucaucagaaggggccuggaaacaugcccagagaauugaaacuuggauucugagacauccaggcuucacuauaauggccgcaauccuggcauacaccauaggaacgacgcauuuucaaagaguccugauauucauccuacugacagccaucgcuccuucaaugacaaugcgcugcauaggaauaucaaauagggacuuuguggaaggagugucaggagggaguuggguugacauaguuuuagaacauggaaguugugugacgacgauggcaaaaaauaaaccaacacuggacuuugaacugauaaaaacagaagccaaacaacccgccuccuuaaggaaguacuguauagaggcuaaacugaccaacacgacaacagacucgcgcugcccaacacaaggggaacccacccugaaugaagagcaggacaaaagguuugucugcaaacauuccaugguagacagaggauggggaaauggauguggauuguuuggaaaaggaggcaucgugaccugugcuauguucacaugcaaaaagaacauggaaggaaaaauugugcagccagaaaaccuggaauacacugucgugauaacaccucauucaggggaagaacaugcagucggaaaugacacaggaaaacaugguaaagaagucaagauaacaccacagagcuccaucacagaggcggaacugacaggcuauggcacuguuacgauggagugcucuccaagaacgggccucgacuucaaugagaugguguugcugcaaauggaagacaaagcuuggcuggugcacagacaaugguuccuagaccuaccguugccauggcugcccggagcagacacacaaggaucaaauuggauacagaaagagacauuggucaccuucaaaaauccccaugcgaaaaaacaggauguuguugucuuaggaucccaagaaggggcuaugcacacagcacucacaggggcuacagaaauccagaugucaucaggaaaccugcuguucacaggacaucucaaaugcaggcugagaauggauaaauuacaacuuaaagggaugucauacuccaugugcacaggaaaguuuaaaauugugaaggaaauagcagaaacacaacauggaacaauagucauuagaguacaauaugaaggagacggcucuccuugcaagauccccuuugagauaauggaucuggaaaaaagacauguuuugggccgccugaucacagucaacccaauuguaacagaaaaggacaguccagucaacauagaagcagaaccuccauuuggagacagcuacaucaucauaggaguggaaccaggacaauugaagcuggacugguucaagaaaggaaguuccauuggccaaauguuugagacaacaaugaggggagcgaaaagaauggccaucuugggcgacacagccugggacuuuggaucucugggaggaguguucacaucaauaggaaaagcucuccaccagguuuuuggagcaaucuacggggcugcuuucaguggggucucauggaccaugaagauccuuauaggaguuaucauuacauggauaggaaugaacucacguagcacaucacugucugugucacugguauuagugggaaucgugacacuguacuugggaguuauggugcaagcugauagugguugcguugugagcuggaagaacaaagaauuaaaauguggcaguggaauauucgucacagauaacgugcauacauggacagaacaauacaaguuucaaccagaauccccuucaaaacuggccucagccauccagaaagcucacgaagaaggcaucuguggaauccgcucaguaacaagacuggaaaaucuuauguggaaacagauaacaccagaauugaaucauauucuaucagaaaaugaagugaaacugaccaucaugacaggagacaucaaaggaauuaugcagguaggaaaacgaucucugcggccucaacccacugaguugagguauucauggaaaacaugggguaaagcgaaaaugcucuccacagaacuccacaaucagaccuuccucauugauggucccgaaacagcggaaugccccaacacaaacagagcuuggaauucacuagaaguugaggacuauggcuuuggaguauucacuaccaauauauggcuaagauugagagaaaagcaggauguauuuugugacucaaaacucaugucagcggccauaaaggacaacagggcuguccaugcugauauggguuauuggauagaaagcgcacucaaugauacauggaagauagagaaagcuucuuucauugaagucaaaaguugccacuggccaaagucacacacucuauggaguaauggagugcuagaaagcgagaugguaauuccaaagaacuacgcuggaccagugucacaacauaauaacagaccaggcuaucacacacaaacagcaggaccuuggcaucuaggcaagcuugagauggacuuugauuucugcgaagggaccacaguggugguaaccgaggaauguggaaacagagggccuucuuuaagaacaaccacugccucaggaaaacucauaacggaaugguguugucgaucuugcacacuaccaccacuaagauacagaggugaggauggaugcugguacgggauggaaaucagaccauugaaagagaaagaagaaaaucuggucaguucucuggucacagccggacaugggcagauugacaauuucucauuaggaauuuugggaauggcacuguuccuugaagaaaugcucaggagucgaguaggaacgaaacaugcaauacuacuagucgcaguuucuuucguaacguuaaucacagggaacaugucuuuuagagaccugggaagagugaugguuauggugggugccacuaugacagaugacauaggcauggguguaacuuaucuugcucuacuagcagccuacaaagucagaccaaccuuugcagcuggauugcuccugagaaaacugaccuccaaggaacuaaugaugaccaccauaggaaucguucuucucucucagaguagcauaccagagaccauucuugagcugaccgaugcguuagcuuuaggcaugaugguccucaagauggugagaaacauggaaaaauaucagcuggcagugacuaucauggcuauuuugugugucccaaaugcugugauauuacagaacgcauggaaagugaguugcacaacacuggcaguggugucuguuuccccccugcucuugacauccucacaacagaaagcggauuggauaccauuagcguugacgaucaaaggccucaauccaacagccauuuuucuaacaacccucucaagaacuagcaagaaaaggagcuggccuuuaaacgaggccaucauggcgguugggauggugaguaucuuggccagcucucucuugaagaacgacauccccaugacaggaccauuaguggcuggagggcuucuuacugugugcuacguauuaacugggcggucagccgaccuggaacuagagagagcuaccgaugucaaaugggaugaccaggcagagauaucagguagcaguccaauucugucgauaacaauaucagaagauggcagcaugucgauaaagaaugaagaggaagagcaaacacugacuauacucauuagaacaggauugcuugugaucucaggacucuuuccgguaucaacaccaauuacagcggcagcaugguaccugugggaaguaaagaaacagcgggcuggaguguugugggauguucccucaccaccacccgugggaaaggccgaauuggaagauggagccuacagaauuaagcaaaaaggaauccuaggauauucccagaucggagcuggaguuuacaaagagggaacauuucacaccauguggcacgucacacgcggcgcuguccuaaugcauaaagggaaaaggauugaaccgucaugggcggacgucaagaaagacuuaauaucauauggaggagguuggaagcuagaaggagaauggaaagaaggagaagaaguccaggucuuggcauuggaaccuggaaaaaauccaagagccguccaaacaaaaccuggccuuuuuagaaccaacacuggaaccauaggugccguaucccuagacuuuuccccugggacgucaggaucuccaaucguugacaaaaaaggaaaaguuguaggccucuauggcaauggugucguuacaaggaguggagcauaugugagugccauagcucagacugaaaaaagcauugaagacaauccagagauugaagaugacaucuuucgaaagagaagauugacuaucauggaucuccacccaggagcaggaaagacaaagagauaccucccggccauagucagagaggccauaaaaagaggcuugagaacacuaauccuagcccccacuagagucguggcagcugaaauggaggaagcccuuagaggacuuccaauaagauaccaaacuccagccaucagggcugaacacaccgggcgggagaucguggacuuaaugugucaugccacauuuaccaugaggcugcuaucaccaaucagggugccaaauuacaaccugaucaucauggacgaagcucauuuuacagauccagcaagcauagcagcuagaggauacaucucaacucgaguggagaugggugaggcagcuggaauuuuuaugacagccacuccuccggguagcagagauccauuuccucagaguaaugcaccaauuauggaugaagaaagagaaauuccggaacguucauggaacuccgggcacgagugggucacggauuuuaaaggaaagacugucugguuuguuccaagcauaaaagccggaaaugacauagcaaccugccugagaaagaauggaaagagggugauacaacucaguaggaagaccuuugauucugaauacgucaagacuagaaccaaugacugggauuucguggucacaacugacauuucggaaaugggugccaacuuuaaagcugagaggguuauagaccccagacgcugcaugaaaccaguuauacugacagacggcgaagagcgggugauccuggcaggacccaugccagugacccacuccagugcagcacaaagaagagggagaauaggaaggaauccaaggaaugaaaaugaucaauacauauauaugggagaaccccuggaaaaugaugaagacugugcacacuggaaggaagcuaagaugcuccuagauaacaucaacacaccugaaggaauuauucccagcauguucgagccagagcgugaaaagguggaugccauugacggugaauaucgcuugagaggagaagcacggaaaacuuuuguggaccuaaugagaagaggagaccuaccagucuggcuggcuuauaaaguggcaucugaagguaucaacuacgcagacagaagaugguguuuugacggaacuagaaacaaucaaaucuuggaagaaaauguggaaguggaaaucuggacaaaggaaggggaaaggaaaaaauugaaaccuagaugguuagaugcuaggaucuacuccgacccacuggcgcuaaaagaauucaaggaauucgcagccggaagaaagucccuaacccugaaccuaaucacagagaugggcagacucccaacuuuuaugacucagaaggccagagacgcacuagacaacuuggcggugcugcacacggcugaagcggguggaaaagcauacaaucaugcucucagugaacuaccggagacccuggagacauugcuuuugcugacacuguuagccacagucacgggaggaaucuuucuauuccugaugagcggaagggguauagggaagaugacccugggaauguguugcauaaucacggccagcauccucuuaugguaugcacaaauacaaccacauuggauagcagcuucaauaauauuggaauucuuucucauagucuugcuuauuccagaaccagaaaagcagaggacaccccaggacaaucaauugacuuaugucaucauagccauccucacagugguugcggcaaccauggcuaacgaaauggguuuucuagaaaaaacaaagaaagaccucggacuaggacacauugcaacucagcaaccugagagcaacauucuggacauagaucuacguccagcaucagcauggacguuguaugccguggcuacaacauuuaucacaccaaugcugagacauagcauugaaaauuccucaguaaaugugucccuaacagccauagcuaaccaagccacagugcuaaugggucucgggaaaggauggccauugucaaaaauggacauuggagucccccuccuugccauuggguguuacucacaagucaacccuauaacccucacagcggcucuucuuuuauugguagcacauuaugccaucauaggaccgggacuucaagccaaagcaaccagagaagcucagaaaagagcagcggcgggcaucaugaaaaacccaacuguggauggaauaacagugauagaucuagauccaauacccuaugauccaaaguuugaaaagcaguugggacaaguaaugcuccuaguccuuugcgugacccaagugcugaugaugaggacuacgugggcuuugugugaagccuuaacuuuagcaaccggaccuguguccacauugugggaaggaaauccagggagauucuggaacacaaccauugcagugucaauggcaaacauuuuuagagggaguuaccuugcuggagcuggacuucucuuuucuaucaugaagaacacgacuagcacgagaagaggaacuggcaacauaggagaaacacuaggagagaaauggaaaagcagacugaacgcauugggaaaaagugaauuccagaucuacaaaaaaaguggaauucaagaaguggacagaaccuuagcaaaagaaggcauuaaaagaggagaaacggaucaucacgcugugucgcgaggcucagcaaaacugagaugguucguugaaagaaauuuggucacaccagaagggaaaguaguggaucuugguugcggcagagggggcuggucauacuauugcggaggacugaagaauguaagggaaguuaaaggcuuaacaaaaggaggaccaggacaugaagaaccuaucccuaugucaacauauggguggaaucuaguacgcuuacagagcggaguugacguuuuuuuuguuccaccagagaagugugacacauuguugugugacauaggggaaucaucgccaaauccuacgguagaagcgggacgaacacucagaguccuuaaccuaguggaaaauuggcugaacgauaacacccaauuuugcguaaagguucuuaacccguacaugcccucagucauugaaagaauggaaaccuuacaaaggaaauacggaggagccuuggugagaaauccacucucacggaauuccacacaugaaauguacuggguguccaaugcuuccgggaacguagugucaucagugaacaugauuucaagaaugcugauuaacagauucaccaugagacacaagaaggccaccuaugagccagaugucgaccucggaagcggaacccgcaacauuggaauugaaagugagacaccgaaccuagacauaauugggaagagaauagaaaaaauaaaacaagagcaugaagcgucauggcacuaugaccaagaccacccauacaaaacaugggcuuaccauggcagcuaugaaacaaaacagacuggaucagcaucauccauggugaauggaguagucagauugcugacaaaacccugggacguuguuccaauggugacacagauggcaaugacagacacaacuccuuucggacaacagcgcgucuuuaaagagaagguggauacgagaacccaagaaccaaaagaaggcacaaaaaaacuaaugaaaaucacggcagaguggcucuggaaagaacuaggaaagaagaagacacccagaaugugcaccagagaagaauucacaaaaaaagugagaagcaaugcagccuugggggccauauuuaccgaugagaacaaguggaaaucggcgcgugaggcuguugaagauaauagguuuugggagcugguugacaaggaaagaaaccuccaucuugaaggaaaaugugaaacauguguauacaacaugaugggaaaaagagagaaaaaacuaggagaguuugguaaagcaagaggcagcagagccauaugguacauguggcucggagcacgcuucuuagaguuugaagcccuaggauuuuugaaugaagaccacugguucuccagagagaacucccugaguggaguggaaggagaagggcugcauaaacuagguuacaucuuaagagaggugagcaagaaagaaggaggagcaauguaugccgaugacaccgcaggcugggacacaagaaucacaauagaggauuuaaaaaaugaagaaaugauaacgaaccacauggcaggagaacacaagaaacuugccgaggccauuuuuaaauugacguaccaaaacaagguggugcgugugcaaagaccaacaccaagaggcacaguaauggacaucauaucgagaagagaccaaagggguaguggacaaguugucaccuauggccucaacacuuucaccaacauggaagcacaacuaauuaggcagauggagggggaaggaaucuucaaaagcauccagcacuugacagccucagaagaaaucgcugugcaagauuggcuagcaagaguagggcgugaaagguuaucaagaauggccaucaguggagaugauugcguugugaaaccuuuagaugauagauuugcaagagcucuaacagcucugaaugacaugggaaagguuaggaaagacauacagcaaugggagcccucaagaggauggaacgacuggacacaggugcccuucuguucacaccauuuucacgaguuaauuaugaaagauggucgcacacucguaguuccaugcagaaaccaagaugaauugaucggcagagcccgaauuucccagggagcuggguggucuuuacgggagacggccuguuuggggaagucuuacgcccaaauguggagcuugauguacuuccacagacgugaucucaggcuagcggcaaacgccaucugcucggcagucccgucacacuggguuccaacaagccggacaaccugguccauacacgccagccaugaauggaugacgacggaagacauguugacaguuuggaacagaguguggauccuagaaaauccauggauggaagacaaaacuccaguggaaucaugggaggaaaucccauaucugggaaaaagagaagaccaauggugcggcucgcugaucgggcugacaagcagagccaccugggcgaagaacauccagacagcaauaaaccaagucagaucccucauuggcaaugaggaauacacagauuacaugccauccaugaaaagauucagaagagaagaggaagaggcaggaguuuugugguag

SEQ ID NO: 6991 - RNA, 9876 nt, Artificial Sequence
  derived and/or modified CDS sequence (wt) from DENV-2__KP012546__SS-prME
acugcaggcauaauuauuaugaugauuccaacagugauggcguuccauuugaccacacgcaacggagaaccacacaugaucgucagcagacaagagaaagggaaaagucuucuguuuaaaacagagaacggugugaacauguguacccucauggccauggaccuuggugaacugugugaagacacaaucacuuauaauuguccucuucuuaggcagaaugaaccagaagacauagacuguuggugcaacucuacgucuacauggguaacuuacgggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcuuacaccauaggaacgacauauuuccaaagaguccugaucuucaucuuacugacagcugucgcuccuucaaugacaaugcguuguauaggaauaucaaauagagacuuuguggaagggguaucaggaggaagcuggguugacauaguuuuggaacauggaagcugugugacgacgauggcgaaaaauaaaccaacauuggauuuugaacugauaaaaacagaagccaaacaccccgccacucuaaggaaguacuguauagaggcaaagcugaccaacacaacaacagcaucucgcugcccaacacaaggagaaccuagccuaaaugaagaacaggacaaaagauuuguuugcaaacacuccaugguagacagaggauggggaaauggaugcggauuauuuggaaagggagguaucgugaccugugcaauguucacaugcaaaaagaacauggaaggaaaaaucgugcaaccagaaaacuuggaguacacuauugugauaacaccucacucaggggaagagaaugcagucggaaaugacacaggaaaacacggcaaggaaauuaaaguaacaccacagaguuccaucacagaagcagaacuaacaggcuauggcacuguuacgauggaaugcucuccgagaacgggccucgacuucaaugagaugguguugcugcaaauggaaaauaaggcuuggcuggugcacaggcaaugguuuuuagaccugccguuaccauggcugcccggagcagacacacaaggaucaaauuggauacagaaggagacauuggucacuuucaaaaauccccaugcaaagaaacaggaugucgucguauuaggaucccaagaaggggccaugcacacagcacucacaggggccacggaaauccaaaugucaucaggaaacuuacuguucacaggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccgugcaagaucccuuuugaaauaauggaucuggaaaagagacaugucuuaggucgcuugauuacagucaacccaauugucacggaaaaagacagcccagucaacauagaagcagaaccuccuuucggggacagcuacaucauuauaggaguagaaccaggacaacugaaacucagcugguuuaagaaaggaaguucuauuggccaaauguuugagacaacaaugagaggagcgaagagaauggccauuuuaggugacacagcuugggauuuuggaucccugggagggguguucacauccauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacguucccugcggccucaacccacugagcugaaguacuccuggaaaacauggggcaaggcgaaaaugcucuccacagagcuucauaaccacacuuuucucauugauggccccgaaacagcagaaugucccaacacaaacagagcuuggaacucacuagaaguugaagacuauggcuuuggaguauuuaccaccaacauauggcugaaauugaaagaaaggcaggauguauuuugugacucaaaacucaugucagcagccauaaaagacaacagagccguccacgccgacauggguuauuggauagaaagcgcacucaaugacacauggaagauugagaaggccucuuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugaaauggacuucgauuucugugaaggaaccacagugguggugacugaggacuguggaaauagaggacccucuuuaagaacaacuacugcuucuggaaaacucauaacagaguggugcugccgaucuugcacauuaccaccgcuaagguacagaggugaggacggaugcugguauggaauggaaauuagaccauugaaagagaaagaagagaacuuggucaacucuuuggucacagccggacauggacagauugauaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcugcuaugacggaugacauaggcaugggcgugacuuaccuugcccuauuagcagccuucaaagucagaccaacuuuugcagcuggacuacucuuaagaaagcugaccuccaaggaauugaugaugaccaccauaggaaucgugcuccucucccagagcaccaugccagagacuauacuugaacugacugacgcguuggcuuuggggaugaugguucucaaaauagugagaaacauggaaaaguaucaacuagcagugacuaucauggccaucuugugcgucccaaaugcagugauauuacaaaacgcauggaaagugagcugcacaacacuggcaguggugucuguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggccauuauggcagucgggauggugagcauuuuagccaguucucucuuaaagaaugauauucccaugacaggaccauuaguggcuggagggcuucucacuguguguuacgugcucacuggaagaucggcugauuuagaacuggagagagcugcugacguaagaugggaagaacaggcggagauaucaggaaguaguccaauucugucgauaacaauaucggaagaugguagcaugucgauaaaaaaugaagaagaagaacaaacacugaccauacucaucagaacaggacugcuggugauaucaggacuuuuucccgugucaauaccaaucacggcagcugcaugguaccugugggaagugaaaaaacaacgagcaggaguauugugggaugucccuucacccccaccugugggaaaggccgaacuggaagauggagccuauagaaucaagcagaaagggauucuaggauacucgcagaucggagccggaguuuacaaagaaggaacauuccacacaauguggcaugucacacguggcgcuguccuaaugcauaaagggaagagaauugaaccaucaugggcggacguaaagaaagaucuaauaucguauggaggaggcuggaaauuagaaggagaauggaaggaaggagaagaaguccagguccuggcauuagagcccggaaagaauccaagagccguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaacggugucguuacaaggaguggaacauacgugagugcuauagcccagacugaaaaaagcaucgaagacaauccagagauugaagaugacaucuuucgaaagaaaagacugaccaucauggaccuccacccaggagcaggaaaaacaaagagauaccuuccagcaauagucagagaagccauaaaacgaggcuugagaacacuaauccuggcccccacuagaguuguggcagcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauucccucagagcaaugcaccaaucauggaugaagaaagagaaaucccugagcguucguggaacucuggacaugaguggguuacugauuuuaaagggaagacuguuugguuuguuccgaguauaaaagcagggaaugauauagcagcuugccugagaaagaauggaaagaaggugauacaacucagcaggaagacuuuugauucugaauauauuaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacucacucuagugcagcacaaagaagagggagaguaggaagaaauccaaaaaaugaaaaugaccaguacauauacaugggggaaccucuggaaaaugaugaagacugugcacacuggaaagaagcuaaaaugcuucuagacaacaucagcacgccugaaggaaucauucccagcauguuugaaccagagcgcgaaaagguggaugccauugauggugaauaccgcuugagaggagaagcgaggaaaacuuuuguggaccuaaugagaagaggagaccuaccagucugguuagccuacagaguggcagcugaagguaucaauuacgcagauagaagauggugcuuugauggagucaagaacaaccaaauuuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccuaaaucuaaucacagagauggguaggcucccaaccuucaugacccagaaagcaaggaaugcacuggauaacuuagcagucuugcauacagcugaagcaggcggaagggcguacaaucaugcucucagugaacugccggagacucuggagacauugcuuuugcugacacucuuggccgcagucacgggcggaaucuuccuguucuugaugagcggaaaagguauagggaagaugaccuugggaaugugcugcauaauuacggccaguauucuccuaugguaugcacaaauacagccacacuggauagcagcuucaauaauacuggaguuuuuucucauagucuugcucauuccagaaccagaaaagcagagaacaccucaagauaaccaauuaacuuauguugucauagccauccuuacagugguggccgcaaccauggcgaacgagauggguuuccuggaaaaaacaaagaaagauuucggauugggaagcacuacaacccagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauuaucaaaaauggacaucggaguuccucuucuugcuaucgggugcuauucacaagucaaccccauaacucucacagcagcccuucucuuauugguagcacauuaugcuaucauagggccaggacuccaagcgaaagcaacuagagaggcccagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggaccacaugggcuuuaugugaagcucuaaccuuagcaaccgggcccaucucuacacugugggaaggaaauccaggaagauucuggaauacaacuauugcagugucaauggcuaacauuuuuagagggaguuaccuggccggagccggacuucucuuuucuaucaugaagaacacggccaauacaagaaggggaacuggcaacacaggagagacgcuuggagagaaauggaaaaaccgguugaaugcacuggggaagagugaauuccagaucuauaagaaaaguggaauccaggaaguggauagaaccuuagcaaaagaaggcaucaaaagaggagaaacggaccaucacgcugugucgcgaggcucggcgaaacugagaugguucgucgagagaaaccuggucacaccagaagggaaaguaguggaccuugguugcggcagggggggcuggucauacuauugugggggacuaaagaauguaaaagaagucaaaggccuaacaaaaggaggaccaggacacgaagaacccauucccaugucaacauaugguuggaaucuggugcgucuacaaaguggaguugauguuuuuuuuacuccgccagaaaagugugacacauugcugugugacauaggggagucgucaccaaaccccacgguugaagcaggacgaacacucagaguucuaaacuuaguggaaaauuggcugaacaauaacacccaauuuugcauaaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagacguugaccucggaaguggaacccgcaacaucggaauugaaagugagacaccaaauuuagacauaauugggaaaagaauagaaaaaauaaaacaggagcaugaaacaucauggcacuaugaccaagaccauccauacaaaacgugggccuaccauggcagcuacgaaacaaagcagacuggaucagcaucuuccauggugaacggagugguuaggcugcuaacaaaaccaugggacguuaucccuauggugacacagauggcaaugacagauacgacuccauuuggacaacagcgcguuuucaaagagaaaguggauacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaaguaaugcagccuuaggcgccauauucacugaugagaacaaguggaagucggcacgugaggcuguugaagacaguggauuuugggaauugguugauaaggaaaggaaucuccaucuugaaggaaagugugagacauguguauauaacaugaugggaaagagagaaaagaagcuaggggaguucgguaaagcgaagggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuugaaaaaugaagaaauggugacaaaccacauggaaggagaacacaagaaacuugcugaagccaucuucaaauuaacguaccaaaacaagguggugcgugugcaaagaccaacaccaaggggcacaguaauggacauuauaucgagaagagaccaaagagguaguggacaaguuguuaccuacggccucaauacuuucaccaacauggaagcccaacugaucagacagauggagggagaaggagucuucaaaagcauccagcaacugacagucacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggagcccucaagaggauggaaugauuggacacaagugccuuuuuguucacaccauuuccaugaguuaaucaugaaggacggucguguacucguaguuccaugcagaaaucaagaugaacugauugguagggcccgaauuucucagggagccgggugguccuugcgggaaacagccuguuuggggaagucuuacgcccaaauguggaaccugauguacuuccacagacgugaccuuaggcuggcggcaaaugccauuugcucggcagucccaucacacuggguuccaacaagucgaacaaccugguccauacacgccacacaugaguggaugacaacagaagacaugcugacagucuggaacaggguguggauucaagagaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaggaggaagaggcaggagucuugugguag

SEQ ID NO: 6992 - RNA, 9876 nt, Artificial Sequence
  derived and/or modified CDS sequence (wt) from DENV-2__KP723478__SS-prME
acugcaggcauaauuauuaugaugauuccaacagugauggcguuccauuugaccacacgcaacggagaaccacacaugaucgucagcagacaagagaaagggaaaagucuucuguuuaaaacagagaacggugugaacauguguacccucauggccauggaccuuggugaacugugugaagacacaaucacuuauaauuguccucuucuuaggcagaaugaaccagaagacauagacuguuggugcaacucuacgucuacauggguaacuuacgggacaugcaccgccacaggagaacacagaagggaaaaaagaucaguggcacucguuccacaugugggaaugggacuggagacacgaacugaaacauggaugucaucagaaggggccuggaaacaugcccagagaauugaaaccugggucuugagacauccaggcuucaccauaauggcagcaauccuggcuuacaccauaggaacgacauauuuccaaagaguccugaucuucaucuuacugacagcugucgcuccuucaaugacaaugcguuguauaggaauaucaaauagagacuuuguggaagggguaucaggaggaagcuggguugacauaguuuuggaacauggaagcugugugacgacgauggcgaaaaauaaaccaacauuggauuuugaacugauaaaaacagaagccaaacaccccgccacucuaaggaaguacuguauagaggcaaagcugaccaacacaacaacagcaucucgcugcccaacacaaggagaaccuagccuaaaugaagaacaggacaaaagauuuguuugcaaacacuccaugguagacagaggauggggaaauggaugcggauuauuuggaaagggagguaucgugaccugugcaauguucacaugcaaaaagaacauggaaggaaaaaucgugcaaccagaaaacuuggaguacacuauugugauaacaccucacucaggggaagagaaugcagucggaaaugacacaggaaaacacggcaaggaaauuaaaguaacaccacagaguuccaucacagaagcagaacuaacaggcuauggcacuguuacgauggaaugcucuccgagaacgggccucgacuucaaugagaugguguugcugcaaauggaaaacaaggcuuggcuggugcacaggcaaugguuuuuagaccugccguuaccauggcugcccggagcagacacacaaggaucaaauuggauacagaaggagacauuggucacuuucaaaaauccccaugcaaagaaacaggaugucgucguauuaggaucccaagaaggggccaugcacacagcacucacaggggccacggaaauccaaaugucaucaggaaacuuacuguucacaggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccaugcaagaucccuuuugaaauaauggaucuggaaaagagacaugucuuaggucgcuugauuacagucaacccaauugucacggaaaaagacagcccagucaacauagaagcagaaccuccuuucggggacagcuacaucauuauaggaguagaaccaggacaacugaaacucagcugguuuaagaaaggaaguucuauuggccaaauguuugagacaacaaugagaggagcgaagagaauggccauuuuaggugacacagcuugggauuuuggaucccugggagggguguucacauccauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacguucccugcggccucaacccacugagcugaaguacuccuggaaaacauggggcaaggcgaaaaugcucuccacagagcuucauaaccacacuuuucucauugauggccccgaaacagcagaaugucccaacacaaacagagcuuggaacucacuagaaguugaagacuauggcuuuggaguauuuaccaccaacauauggcugaaauugaaagaaaggcaggauguauuuugugacucaaaacucaugucagcagccauaaaagacaacagagccguccacgccgacauggguuauuggauagaaagcgcacucaaugacacauggaagauugagaaggccucuuuuauugaaguuaaaagcugccacuggccaaagucacacacucucuggaguaauggagugcuagaaagugagaugauaauuccaaagaauuuugcaggaccaaugucacaacacaauuacagaccaggcuaucauacacaaacggcaggacccuggcaucuaggcaggcuugaaauggacuucgauuucugugaaggaaccacagugguggugacugaggacuguggaaauagaggacccucuuuaagaacaacuacugcuucuggaaaacucauaacagaguggugcugccgaucuugcacauuaccaccgcuaagguacagaggugaggacggaugcugguauggaauggaaauuagaccauugaaagagaaagaagagaacuuggucaacucuuuggucacagccggacauggacagauugauaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcugcuaugacggaugacauaggcaugggcgugacuuaccuugcccuauuagcagccuucaaagucagaccaacuuuugcagcuggacuacucuuaagaaagcugacauccaaggaauugaugaugaccaccauaggaaucgugcuccucucccagagcaccaugccagagacuauacuugaacugacugacgcguuggcuuuggggaugaugguucucaaaauagugagaaacauggaaaaguaucaacuagcagugacuaucauggccaucuugugcgucccaaaugcagugauauuacaaaacgcauggaaagugagcugcacaacacuggcaguggugucuguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggccauuauggcagucgggauggugagcauuuuagccaguucucucuuaaagaaugauauucccaugacaggaccauuaguggcuggagggcuucucacuguguguuacgugcucacuggaagaucggcugauuuagaacuggagagagcugcugacguaagaugggaagaacaggcggagauaucaggaaguaguccaauucugucgauaacaauaucggaagaugguagcaugucgauaaaaaaugaagaagaagaacaaacacugaccauacucaucagaacaggacugcuggugauaucaggacuuuuucccgugucaacaccaaucacggcagcugcaugguaccugugggaagugaaaaaacaacgagcaggaguauugugggaugucccuucacccccaccugugggaaaggccgaacuggaagauggagccuauagaaucaagcagaaagggauucuaggauacucgcagaucggagccggaguuuacaaagaaggaacauuccacacaauguggcaugucacacguggcgcuguccuaaugcauaaagggaagagaauugaaccaucaugggcggacguaaagaaagaucuaauaucguauggaggaggcuggaaauuagaaggagaauggaaggaaggagaagaaguccagguccuggcauuagagcccggaaagaauccaagagccguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaacggugucguuacaaggaguggaacauacgugagugcuauagcccagacugaaaaaagcaucgaagacaauccagagauugaagaugacaucuuucgaaagaaaagacugaccaucauggaccuccacccaggagcaggaaaaacaaagagauaccuuccagcaauagucagagaagccauaaaacgaggcuugagaacacuaauccuggcccccacuagaguuguggcagcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauucccucagagcaaugcaccaaucauggaugaagaaagagaaaucccugagcguucguggaacucuggacaugaguggguuacugauuuuaaagggaagacuguuugguuuguuccgaguauaaaagcagggaaugauauagcagcuugccugagaaagaauggaaagaaggugauacaacucagcaggaagacuuuugauucugaauauauuaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacucacucuagugcagcacaaagaagagggagaguaggaagaaauccaaaaaaugaaaaugaccaguacauauacaugggggaaccucuggaaaaugaugaagacugugcacacuggaaagaagcuaaaaugcuucuagacaacaucagcacgccugaaggaaucauucccagcauguuugaaccagagcgcgaaaagguggaugccauugauggugaauaccgcuugagaggagaagcgaggaaaacuuuuguggaccuaaugagaagaggagaccuaccagucugguuagccuacagaguggcagcugaagguaucaauuacgcagauagaagauggugcuuugauggagucaagaacaaccaaauuuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccuaaaucuaaucacagagauggguaggcucccaaccuucaugacccagaaagcaaggaaugcacuggauaacuuagcagucuugcauacagcugaagcaggcggaagggcguacaaucaugcucucagugaacugccggagacucuggagacauugcuuuugcugacacucuuggccgcagucacgggcggaaucuuccuguucuugaugaguggaaaagguauagggaagaugacccugggaaugugcugcauaaucacagccaguauucuucuaugguaugcacaaauacagccacacuggauagcagcuucaauaauacuggaguuuuuucucauagucuugcucauuccagaaccagaaaagcagagaacaccucaagauaaccaauuaacuuauguugucauagccauccuuacagugguggccgcaaccauggcgaacgagauggguuuccuggaaaaaacaaagaaagauuucggauugggaagcacuacaacccagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccucuucucgcuaucgggugcuauucacaagucaaccccauaacucucacagcagcccuucucuuauugguagcacauuaugcuaucauagggccaggacuccaagcgaaagcaacuagagaggcccagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggaccacaugggcuuuaugugaagcucuaaccuuagcaaccgggcccaucucuacacugugggaaggaaauccaggaagauucuggaauacaacuauugcagugucaauggcuaacauuuuuagagggaguuaccuggccggagccggacuucucuuuucuaucaugaagaacacggccaauacaagaaggggaacuggcaacacaggagagacgcuuggagagaaauggaaaaaccgguugaaugcacuggggaagagugaauuccagaucuauaagaaaaguggaauccaggaaguggauagaaccuuagcaaaagaaggcaucaaaagaggagaaacggaccaucacgcugugucgcgaggcucggcgaaacugagaugguucgucgagagaaaccuggucacaccagaagggaaaguaguggaccuugguugcggcagggggggcuggucauacuauugugggggacuaaagaauguaaaagaagucaaaggccuaacaaaaggaggaccaggacacgaagaacccauucccaugucaacauaugguuggaaucuggugcgucuacaaaguggaguugauguuuuuuuuacuccgccagaaaagugugacacauugcugugugacauaggggagucgucaccaaaccccacgguugaagcaggacgaacacucagaguucuaaacuuaguggaaaauuggcugaacaauaacacccaauuuugcauaaagguucucaacccauacaugcccucaguuauagaaaagauggaagcgcugcaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagacguugaccucggaaguggaacccgcaacaucggaauugaaagugagacaccaaauuuagacauaauugggaaaagaauagaaaaaauaaaacaggagcaugaaacaucauggcacuaugaccaagaccauccauacaaaacgugggccuaccauggcagcuacgaaacaaagcagacuggaucagcaucuuccauggugaacggagugguuaggcugcuaacaaaaccaugggacguuaucccuauggugacacagauggcaaugacagauacgacuccauuuggacaacagcgcguauucaaagagaaaguggauacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaaguaaugcagccuuaggcgccauauucacugaugagaacaaguggaagucggcacgugaggcuguugaagacaguggauuuugggaauugguugauaaggaaaggaaucuccaucuugaaggaaagugugagacauguguauauaacaugaugggaaagagagaaaagaagcuaggggaguucgguaaagcgaagggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuugaaaaaugaagaaauggugacaaaccacauggaaggagaacacaagaaacuugcugaagccaucuucaaauuaacguaccaaaacaagguggugcgugugcaaagaccaacaccaaggggcacaguaauggacauuauaucgagaagagaccaaagagguaguggacaaguuguuaccuacggccucaauacuuucaccaacauggaagcccaacugaucagacagauggagggagaaggagucuucaaaagcauccagcaacugacagucacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggagcccucaagaggauggaacgauuggacacaagugccuuuuuguucacaccauuuccaugaguuaaucaugaaggacggucguguacucguaguuccaugcagaaaucaagaugaacugauugguagggcccgaauuucucagggagccgggugguccuugcgggaaacagccuguuuggggaagucuuacgcccaaauguggaaccugauguacuuccacagacgugaccuuaggcuggcggcaaaugccauuugcucggcagucccaucacacuggguuccaacaagucgaacaaccugguccauacacgccacacaugaguggaugacaacagaagacaugcugacagucuggaacaggguguggauucaagagaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaggaggaagaggcaggagucuugugguag

SEQ ID NO: 6993 - RNA, 9876 nt, Artificial Sequence
  derived and/or modified CDS sequence (wt) from DENV-2__KP723479__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagauugcuggugcaacucuacgucuacauggguaacuuacgggacaugcaccgccacaggagaacacagaagggaaaaaagaucaguggcacucguuccacaugugggaaugggacuggagacacgaacugaaacauggaugucaucagaaggggccuggaaacaugcccagagaauugaaacgugggucuugagacauccaggcuucaccauaauggcagcaauccuggcuuacaccauaggaacgacauacuuccaaagaguccugaucuucaucuuacugacagcugucgcuccuucaaugacaaugcguuguauaggaauaucaaauagagacuuuguggaagggguaucaggaggaagcuggguugacauagucuuggaacauggaagcugugugacgacgauggcgaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggagguaucgugaccugugcaauguucacaugcaaaaagaacauggaaggaaaaaucgugcaaccagaaaacuuggaguacaccaucgugauaacaccucacucaggggaagagaaugcagucggaaaugacacaggaaaacacggcaaggaaauuaaaguaacaccacagaguuccaucacagaagcagaacuaacaggcuauggcacuguuacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggccaugcacacagcacucacaggggccacggaaauccagaugucaucaggaaacuugcuguucacaggacaucuuaaguguaggcugagaauggacaaauuacaacucaaaggaaugucauauuccauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaaucgucacagagaaagacagcccagucaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuuaggagggguguucacauccauaggaaaggcccuccaccaagucuuuggagcaauuuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuagagaaucugauguggaaacaaauaacaccagaacugaaucacauuuuaucagaaaaugagguaaaguugacuaucaugacaggagacauuaaaggaaucaugcaggcaggaaaacgaucccuacggccucaacccacugaguugaaguacucuuggaaagcauggggcaaagcgaaaaugcucuccacagagcuucauaaccacaccuuucucauugauggccccgaaacagcagaaugucccaacacaaacagagcuuggaacucacuagaaguugaagacuauggcuuuggaguauuuaccaccaacauauggcugaaaaugaaagaaaggcaggauguauuuugugacucaaaacucaugucagcagccauaaaagacagcagagccguccacgccgauauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugagauggacuucgauuucugcgaaggaaccacagugguggugacugaggacuguggaaauagaggacccucuuuaagaacaacuacugcuucuggaaaacucauaacagagugguguugccgaucuugcacacuaccaccgcuaagguacagaggugaggauggaugcugguauggaauggaaauuagaccauugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuauuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaaucgugcuccucucccaggccaccauaccagagacuauacuugaacugacugacgcguuggcuuuggggaugaugguucucaaaauagugagaaacauggaaaaguaucaacuagcagugacuaucauggccaucuugugcgucccaaaugcagugauauuacaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuaacaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuggugguaucaggacucuuucccgugucaacaccaaucacggcagcugcaugguaccugugggaagugaaaaaacaacgagcaggaguauugugggaugucccuucacccccaccugugggaaaggccgaacuggaggauggagccuacagaaucaagcagaaagggauucuaggauacucgcagaucggagcuggaguuuacaaagaaggaacauuucacacaauguggcaugucacacguggugcuguucuaaugcauaaagggaagagaauugaaccaucaugggcggacgucaagaaagaucuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggugccgugucucuggacuuuucuccuggaacgucaggaucuccaaucgucgacaaaaaaggaaaaguugugggccuuuauggcaacggugucguuacaaggaguggaacauaugugagugcuauagcccagacugaaaaaagcaucgaagacaauccagagauugaagaugacaucuuucgaaagaaaagauugaccaucauggaccuccauccaggagcaggaaaaacaaagagauaccuuccagcaauagucagagaagccauaaaacgaggcuugagaacacuaauccuggcccccacuagagugguggcggcugaaauggaagaagcucucagaggacuuccaauaagauaccaaaccccagcuaucagagcugagcacacugggcgggagauuguggaucuaaugugucacgccacauuuaccaugaggcugcuaucaccaauuagagugccaaauuacaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaaugcaccaaucauggaugaagaaagggaaaucccugagcguucguggaacucuggacaugaguggguuacggauuuuaaagggaagacuguuugguuuguuccaaguauaaaagcagggaaugacauagcagcuugccugagaaagaauggaaagaaagugauacaacucagcaggaagacuuuugacucugaauauaucaagacuaggaccaaugauugggacuuuguggucacgacagacauuucagagaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagccaaaaugcuucuagacaacaucaacacgccugaaggaaucauucccagcauguucgaaccagagcgcgaaaagguggaugccauugauggugaauaccgcuugagaggagaagcgaggaaaacuuucguggaccuaaugagaagaggagaccuaccagucugguuagccuacagaguggcagcugaagguaucaauuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaguucgcagcuggaagaaagucccugacccugaaucuaaucacagagauggguaggcucccaaccuucaugacccagaaagcaaggaaugcacuggauaacuuagcagucuugcauacagcugaagcaggcggaagggcguacaaucaugcucuuagugaacugccggagacucuggagacauugcuuuuacugacacucuuggccacagucacgggcggaaucuuccuguucuugaugagcggaaaagguauagggaagaugaccuugggaaugugcugcauaauuacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaagcauuacaacccagcaaccugagaacaacauccuggacauagaucuacguccugcaucagcuuggacucuauaugccguggcaacaacuuucaucacaccaauguugagacauagcauugaaaauuccucagugaaugugucucuaacagcuauugccaaccaagccacgguguuaaugggucuugggaaaggauggccauuaucaaaaauggacaucggaguuccccuucucgcuaucgggugcuauucacaagucaaccccauaacucucacagcagcccuucuccuauugguagcacauuaugcuaucauagggccaggacuccaagcgaaagcaacuagagaagcucagaaaagagcagcagcgggcaucaugaaaaacccaacuguggauggaauaacagugauugaccuagauccaauacccuaugacccaaaguuugaaaagcaguugggacaaguaaugcucuuaguccucugcgugacucaaguauugaugaugaggaccacaugggcuuuaugugaagcucuaaccuuagcaaccgggcccaucucuacacugugggaaggaaauccaggaagauucuggaauacaacuauugcagugucaauggcuaacauuuuuagagggaguuaccuggccggagccggacuucucuuuucuaucaugaagaacacggccaacacaagaaggggaacuggcaacacgggagagacgcuuggagagaaauggaaaaaccgguugaaugcauugggaaagagugaauuccagaucuauaagaaaaguggaauccaggaaguggauagaaccuuagcaaaagaaggcaucaaaagaggagaaacggaccaucaugcugugucgcgaggcucggcgaaacugagaugguucgucgagagaaaccuggucacaccagaagggaaaguaguggaccuugguuguggcaggggaggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuuuacuccgccagaaaagugugacacauugcugugugacauaggggagucgucaccaaaccccacuguugaagcaggacgaacacucagaguucuaaaccuaguggaaaauuggcugaacaauaacacccaauuuugcauaaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaauaugauuucaagaauguugaucaacagauucacaaugagacacaagaaggccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacguuaucccuauggugacacagauggcaaugacagacacgacuccauuuggacaacagcgcguuuucaaagagaaaguggacacgagaacccaagaaccgaaagaaggcacgaaaaaacuaaugaagaucacggcagaauggcucuggaaagaacuaggaaagaaaaagacaccuaggaugugcaccagagaagaauucacaagaaaggugagaaguaaugcagccuuaggcgccauauucacugaugagaacaaguggaagucggcacgugaggcuguugaagacagcggauuuugggaauugguugacaaggaaaggaaucuccaucuugaaggaaagugugagacauguguauauaacaugaugggaaagagagagaagaagcuaggggaguucggcaaagcgaaaggcagcagagccauaugguacauguggcuuggagcacgcuucuuagaguuugaagcccuaggauuuuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaagaaacuugcugaagccaucuucaaacuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaacugacaguuacagaagaaauugcagugaaaaacugguuaguaagaguggggcgugagagguuaucaagaauggccauuaguggagaugacuguguugugaaacccuuagaugacagguuugcaagcgcucuaacagcucuaaaugacaugggaaagguuaggaaagacauacaacaaugggaaccuucaagaggauggaacgacuggacacaagugccuuuuuguucacaccauuuccaugaguuaaucaugaaggacggucguguacucguaguuccaugcagaaaucaagaugaacugauugguagggcccgaauuucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacgcaugaguggaugacaacagaagacaugcugacagucuggaacaggguguggauccaagaaaacccauggauggaagacaaaacuccaguggagucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaagaggaagaggcaggagucuugugguag

SEQ ID NO: 6994 - RNA, 9876 nt, Artificial Sequence
  derived and/or modified CDS sequence (wt) from DENV-2__KT187554__SS-prME
acugcaggcauaauuauuaugaugauuccaacagugauggcguuccauuugaccacacgcaacggagaaccacacaugaucgucagcagacaagagaaagggaaaagucuucuguuuaaaacagagaacggugugaacauguguacccucauggccauggaccuuggugaacugugugaagacacaaucacuuauaauuguccucuucuuaggcagaaugaaccagaagacauagacuguuggugcaacucuacgucuacauggguaacuuacgggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcuuacaccauaggaacgacauauuuucaaagaguccugaucuucaucuuacugacagcugucgcuccuucaaugacaaugcguuguauaggaauaucaaauagagacuuuguggaagggguaucaggaggaagcuggguugacauaguuuuggaacauggaagcugugugacgacgauggcgaaaaauaaaccaacauuggauuuugaacugauaaaaacagaagccaaacaccccgccacucuaaggaaguacuguauagaggcaaagcugaccaacacaacaacagcaucucgcugcccaacacaaggagaaccuagccuaaaugaagaacaggacaaaagauuuguuugcaaacacuccaugguagacagaggauggggaaauggaugcggauuauuuggaaagggagguaucgugaccugugcaauguucacaugcaaaaagaacauggaaggaaaaaucgugcaaccagaaaacuuggaguacacuauugugauaacaccucacucaggggaagagaaugcagucggaaaugacacaggaaaacacggcaaggaaauuaaaguaacaccacagaguuccaucacagaagcagaacuaacaggcuauggcacuguuacgauggaaugcucuccgagaacgggccucgacuucaaugagaugguguugcugcaaauggaaaacaaggcuuggcuggugcacaggcaaugguuuuuagaccugccguuaccauggcugcccggagcagacacacaaggaucaaauuggauacagaaggagacauuggucacuuucaaaaauccucaugcaaagaaacaggaugucgucguauuaggaucccaagaaggggccaugcacacagcacucacaggggccacggaaauccaaaugucaucaggaaacuuacuguucacaggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacggcucuccaugcaagaucccuuuugaaauaauggaucuggaaaagagacaugucuuaggucgcuugauuacagucaacccaauugucacggaaaaagacagcccagucaacauagaagcagaaccuccuuucggggacagcuacaucauuauaggaguagaaccaggacaacugaaacucagcugguuuaagaaaggaaguucuauuggccaaauguuugagacaacaaugagaggagcgaagagaauggccauuuuaggugacacagcuugggauuuuggaucccugggagggguguucacauccauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacguucccugcggccucaacccacugagcugaaguacuccuggaaaacauggggcaaggcgaaaaugcucuccacagagcuucauaaccacacuuuucucauugauggccccgaaacagcagaaugucccaacacaaacagagcuuggaacucacuagaaguugaagacuauggcuuuggaguauuuaccaccaacauauggcugaaauugaaagaaaggcaggauguauuuugugacucaaaacucaugucagcagccauaaaagacaacagagccguccacgccgacauggguuauuggauagaaagcgcacucaaugacacauggaagauugagaaggccucuuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugaaauggacuucgauuucugugaaggaaccacagugguggugacugaggacuguggaaauagaggacccucuuuaagaacaacuacugcuucuggaaaacucauaacagaguggugcugccgaucuugcacauuaccaccgcuaagguacagaggugaggacggaugcugguauggaauggaaauuagaccauugaaagagaaagaagagaacuuggucaacucuuuggucacagccggacauggacagauugauaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcugcuaugacggaugacauaggcaugggcgugacuuaccuugcccuauuagcagccuucaaagucagaccaacuuuugcagcuggacuacucuuaagaaagcugaccuccaaggaauugaugaugaccaccauaggaaucgugcuccucucccagagcaccaugccagagacuauacuugaacugacugacgcguuggcuuuggggaugaugguucucaaaauagugagaaacauggaaaaguaucaacuagcagugacuaucauggccaucuugugcgucccaaaugcagugauauuacaaaacgcauggaaagugagcugcacaacacuggcaguggugucuguuuccccacuguuuuuaacauccucacagcagaaagcggauuggauaccacuggcguugacgaucaaaggccucaauccaacagccauuuucuuaacaacccucucaagaacuagcaagaaaaggagcuggccacuaaaugaggccauuauggcagucgggauggugagcauuuuagccaguucucucuuaaagaaugauauucccaugacaggaccauuaguggcuggagggcuucucacuguguguuacgugcucacuggaagaucggcugauuuagaacuggagagagcugcugacguaagaugggaagaacaggcggagauaucaggaaguaguccaauucugucgauaacaauaucggaagaugguagcaugucgauaaaaaaugaagaagaagaacaaacacugaccauacucaucagaacaggacugcuggugauaucaggacuuuuucccgugucaauaccaaucacggcagcugcaugguaccugugggaagugaaaaaacaacgagcaggaguauugugggaugucccuucacccccaccugugggaaaggccgaacuggaagauggagccuauagaaucaagcagaaagggauucuaggauacucgcagaucggagccggaguuuacaaagaaggaacauuccacacaauguggcaugucacacguggcgcuguccuaaugcauaaagggaagagaauugaaccaucaugggcggacguaaagaaagaucuaauaucguauggaggaggcuggaaauuagaaggagaauggaaggaaggagaagaaguccagguccuggcauuagagcccggaaagaauccaagagccguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaacggugucguuacaaggaguggaacauacgugagugcuauagcccagacugaaaaaagcaucgaagacaauccagagauugaagaugacaucuuucgaaagaaaagacugaccaucauggaccuccacccaggagcaggaaaaacaaagagauaccuuccagcaauagucagagaagccauaaaacgaggcuugagaacacuaauccuggcccccacuagaguuguggcagcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauucccucagagcaaugcaccaaucauggaugaagaaagagaaaucccugagcguucguggaacucuggacaugaguggguuacugauuuuaaagggaagacuguuugguuuguuccgaguauaaaagcagggaaugauauagcagcuugccugagaaagaauggaaagaaggugauacaacucagcaggaagacuuuugauucugaauauauuaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacucacucuagugcagcacaaagaagagggagaguaggaagaaauccaaaaaaugaaaaugaccaguacauauacaugggggaaccucuggaaaaugaugaagacugugcacacuggaaagaagcuaaaaugcuucuagacaacaucagcacgccugaaggaaucauucccagcauguuugaaccagagcgcgaaaagguggaugccauugauggugaauaccgcuugagaggagaagcgaggaaaacuuuuguggaccuaaugagaagaggagaccuaccagucugguuagccuacagaguggcagcugaagguaucaauuacgcagauagaagauggugcuuugauggagucaagaacaaccaaauuuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccuaaaucuaaucacagagauggguaggcucccaaccuucaugacccagaaagcaaggaaugcacuggauaacuuagcagucuugcauacagcugaagcaggcggaagggcguacaaucaugcucucagugaacugccggagacucuggagacauugcuuuugcugacacucuuggccgcagucacgggcggaauuuuccuguucuugaugaguggaaaagguauagggaagaugacccugggaaugugcugcauaaucacagccaguauucuucuaugguaugcacaaauacagccacacuggauagcagcuucaauaauacuggaguuuuuucucauagucuugcucauuccagaaccagaaaagcagagaacaccucaagauaaccaauuaacuuauguugucauagccauccuuacagugguggccgcaaccauggcgaacgagauggguuuccuggaaaaaacaaagaaagauuucggauugggaagcacuacaacccagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccucuucucgcuaucgggugcuauucacaagucaaccccauaacucucacagcagcccuucucuuauugguagcacauuaugcuaucauagggccaggacuccaagcgaaagcaacuagagaggcccagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggaccacaugggcuuuaugugaagcucuaaccuuagcaaccgggcccaucucuacacugugggaaggaaauccaggaagauucuggaauacaacuauugcagugucaauggcuaacauuuuuagagggaguuaccuggccggagccggacuucucuuuucuaucaugaagaacacggccaauacaagaaggggaacuggcaacacaggagagacgcuuggagagaaauggaaaaaccgguugaaugcacuggggaagagugaauuccagaucuauaagaaaaguggaauccaagaaguggauagaaccuuagcaaaagaaggcaucaaaagaggagaaacggaccaucacgcugugucgcgaggcucggcgaaacugagaugguucgucgagagaaaccuggucacaccagaagggaaaguaguggaccuugguugcggcagggggggcuggucauacuauugugggggacuaaagaauguaaaagaagucaaaggccuaacaaaaggaggaccaggacacgaagaacccauucccaugucaacauaugguuggaaucuggugcgucuacaaaguggaguugauguuuuuuuuacuccgccagaaaagugugacacauugcugugugacauaggggagucgucaccaaaccccacgguugaagcaggacgaacacucagaguucuaaacuuaguggaaaauuggcugaacaauaacacccaauuuugcauaaagguucucaacccauacaugcccucaguuauagaaaagauggaagcgcugcaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagacguugaccucggaaguggaacccgcaacaucggaauugaaagugagacaccaaauuuagacauaauugggaaaagaauagaaaaaauaaaacaggagcaugaaacaucauggcacuaugaccaagaccauccauacaaaacgugggccuaccauggcagcuacgaaacaaagcagacuggaucagcaucuuccauggugaacggagugguuaggcugcuaacaaaaccaugggacguuaucccuauggugacacagauggcaaugacagauacgacuccauuuggacaacagcgcguuuucaaagagaaaguggauacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaaguaaugcagccuuaggcgccauauucacugaugagaacaaguggaagucggcacgugaggcuguugaagacaguggauuuugggaauugguugauaaggaaaggaaucuccaucuugaaggaaagugugagacauguguauauaacaugaugggaaagagagaaaagaagcuaggggaguucgguaaagcgaagggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagagagaaggaggagcaauguacgccgaugacaccgcaggaugggacacaagaaucacacuagaggacuugaaaaaugaagaaauggugacaaaccacauggaaggagaacacaagaaacuugcugaagccaucuucaaauuaacguaccaaaacaagguggugcgugugcaaagaccaacaccaaggggcacaguaauggacauuauaucgagaagagaccaaagagguaguggacaaguuguuaccuacggccucaauacuuucaccaacauggaagcccaacugaucagacagauggagggagaaggagucuucaaaagcauccagcaacugacagucacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggagcccucaagaggauggaacgauuggacacaagugccuuuuuguucacaccauuuccaugaguuaaucaugaaggacggucguguacucguaguuccaugcagaaaucaagaugaacugauugguagggcccgaauuucucagggagccgggugguccuugcgggaaacagccuguuuggggaagucuuacgcccaaauguggaaccugauguacuuccacagacgugaccuuaggcuggcggcaaaugccauuugcucggcagucccaucacacuggguuccaacaagucgaacaaccugguccauacacgccacacaugaguggaugacaacagaagacaugcugacagucuggaacaggguguggauucaagagaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaggaggaagaggcaggagucuugugguag

SEQ ID NO: 6995 - RNA, 9876 nt, Artificial Sequence
  derived and/or modified CDS sequence (wt) from DENV-2__KT187557__SS-prME
acugcaggcauaauuauuaugaugauuccaacagugauggcguuccauuugaccacacgcaacggagaaccacacaugaucgucagcagacaagagaaagggaaaagucuucuguuuaaaacagagaacggugugaacauguguacccucauggccauggaccuuggugaacugugugaagacacaaucacuuauaauuguccucuucuuaggcagaaugaaccagaagacauagacuguuggugcaacucuacgucuacauggguaacuuacgggacaugcaccgccacaggagaacacagaagggaaaaaagaucaguggcacucguuccacaugugggaaugggacuggagacacgaacugaaacauggaugucaucagaaggggccuggaaacaugcccagagaauugaaaccugggucuugagacauccaggcuucaccauaauggcagcaauccuggcuuacaccauaggaacgacauauuuccaaagaguccugaucuucaucuuacugacagcugucgcuccuucaaugacaaugcguuguauaggaauaucaaauagagacuuuguggaagggguaucaggaggaagcuggguugacauaguuuuggaacauggaagcugugugacgacgauggcgaaaaauaaaccaacauuggauuuugaacugauaaaaacagaagccaaacaccccgccacucuaaggaaguacuguauagaggcaaagcugaccaacacaacaacagcaucucgcugcccaacacaaggagaaccuagccuaaaugaagaacaggacaaaagauuuguuugcaaacacuccaugguagacagaggauggggaaauggaugcggauuauuuggaaagggagguaucgugaccugugcaauguucacaugcaaaaagaacauggaaggaaaaaucgugcaaccagaaaacuuggaguacacuauugugauaacaccucacucaggggaagagaaugcagucggaaaugacacaggaaaacacggcaaggaaauuaaaguaacaccacagaguuccaucacagaagcagaacuaacaggcuauggcacuguuacgauggaaugcucuccgagaacgggccucgacuucaaugagaugguguugcugcaaauggaaaacaaggcuuggcuggugcacaggcaaugguuuuuagaccugccguuaccauggcugcccggagcagacacacaaggaucaaauuggauacagaaggagacauuggucacuuucaaaaauccccaugcaaagaaacaggaugucgucguauuaggaucccaagaaggggcuaugcacacagcacucacaggggccacggaaauccaaaugucaucaggaaacuuacuguucacaggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccaugcaagaucccuuuugaaauaauggaucuggaaaagagacaugucuuaggucgcuugauuacagucaacccaauugucacggaaaaagacagcccagucaacauagaagcagaaccuccuuucggggacagcuacaucauuauaggaguagaaccaggacaacugaaacucagcugguuuaagaaaggaaguucuauuggccaaauguuugagacaacaaugagaggagcgaagagaauggccauuuuaggugacacagcuugggauuuuggaucccugggagggguguucacguccauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacguucccugcggccucaacccacugagcugaaguacuccuggaaaacauggggcaaggcgaaaaugcucuccacagagcuucauaaccacacuuuucucauugauggccccgaaacagcagaaugucccaacacaaacagagcuuggaacucacuagaaguugaagacuauggcuuuggaguauuuaccaccaacauauggcugaaauugaaagaaaggcaggauguauuuugugacucaaaacucaugucagcagccauaaaagacaacagagccguccacgccgacauggguuauuggauagaaagcgcacucaaugacacauggaagauugagaaggccucuuuuauugaaguuaaaagcugccacuggccaaagucacacacucucuggaguaauggagugcuagaaagugagaugauaauuccaaagaauuuugcaggaccaaugucacaacacaauuacagaccaggcuaucauacacaaacggcaggacccuggcaucuaggcaggcuugaaauggacuucgauuucugugaaggaaccacagugguggugacugaggacuguggaaauagaggacccucuuuaagaacaacuacugcuucuggaaaacucauaacagaguggugcugccgaucuugcacauuaccaccgcuaagguacagaggugaggacggaugcugguauggaauggaaauuagaccauugaaagagaaagaagagaacuuggucaacucuuuggucacagccggacauggacagauugauaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcugcuaugacggaugacauaggcaugggcgugacuuaccuugcccuauuagcagccuucaaagucagaccaacuuuugcagcuggacuacucuuaagaaagcugaccuccaaggaauugaugaugaccaccauaggaaucgugcuccucucccagagcaccaugccagagacuauacuugaacugacugacgcguuggccuuggggaugaugguucucaaaauagugagaaacauggaaaaguaucaacuagcagugacuaucauggccaucuugugcgucccaaaugcagugauauuacaaaacgcauggaaagugaguugcacaacacuggcaguggugucuguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggccauuauggcagucgggauggugagcauuuuagccaguucucucuuaaagaaugauauucccaugacaggaccauuaguggcuggagggcuucucacuguguguuacgugcucacuggaagaucggcugauuuagaacuggagagagcugcugacguaagaugggaagaacaggcggagauaucaggaaguaguccaauucugucgauaacaauaucggaagaugguagcaugucgauaaaaaaugaagaagaagaacaaacacugaccauacucaucagaacaggacugcuggugauaucaggacuuuuucccgugucaauaccaaucacggcagcugcaugguaccugugggaagugaaaaaacaacgagcaggaguauugugggaugucccuucacccccaccugugggaaaggccgaacuggaagauggagccuauagaaucaagcagaaagggauucuaggauacucgcagaucggagccggaguuuacaaagaaggaacauuccacacaauguggcaugucacacguggcgcuguccuaaugcauaaagggaagagaauugaaccaucaugggcggacguaaagaaagaucuaauaucguauggaggaggcuggaaauuagaaggagaauggaaggaaggagaagaaguccagguccuggcauuagagcccggaaagaauccaagagccguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaacggugucguuacaaggaguggaacauacgugagugcuauagcccagacugaaaaaagcaucgaagacaauccagagauugaagaugacaucuuucgaaagaaaagacugaccaucauggaccuccacccaggagcaggaaaaacaaagagauaccuuccagcaauagucagagaagccauaaaacgaggcuugagaacacuaauccuggcccccacuagaguuguggcagcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauucccucagagcaaugcaccaaucauggaugaagaaagagaaaucccugagcguucguggaacucuggacaugaguggguuacugauuuuaaagggaagacuguuugguuuguuccgaguauaaaagcagggaaugauauagcagcuugccugagaaagaauggaaagaaggugauacaacucagcaggaagacuuuugauucugaauauauuaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacucacucuagugcagcacaaagaagagggagaguaggaagaaauccaaaaaaugaaaaugaccaguacauauacaugggggaaccucuggaaaaugaugaagacugugcacacuggaaagaagcuaaaaugcuucuagacaacaucagcacgccugaaggaaucauucccagcauguuugaaccagagcgcgaaaagguggaugccauugauggugaauaccgcuugagaggagaagcgaggaaaacuuuuguggaccuaaugagaagaggagaccuaccagucugguuagccuacagaguggcagcugaagguaucaauuacgcagauagaagauggugcuuugauggagucaagaacaaccaaauuuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccuaaaucuaaucacagagauggguaggcucccaaccuucaugacccagaaagcaaggaaugcacuggauaacuuagcagucuugcauacagcugaagcaggcggaagggcguacaaucaugcucucagugaacugccggagacucuggagacauugcuuuugcugacacucuuggccgcagucacgggcggaaucuuccuguucuugaugaguggaaaagguauagggaagaugacccugggaaugugcugcauaaucacagccaguauucuucuaugguaugcacaaauacagccacacuggauagcagcuucaauaauacuggaguuuuuucucauagucuugcucauuccagaaccagaaaagcagagaacaccucaagauaaccaauuaacuuauguugucauagccauccuuacagugguggccgcaaccauggcgaacgagauggguuuccuggaaaaaacaaagaaagauuucggauugggaagcacuacaacccagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccucuucucgcuaucgggugcuauucacaagucaaccccauaacucucacagcagcccuucucuuauugguagcacauuaugcuaucauagggccaggacuccaagcgaaagcaacuagagaggcccagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggaccacaugggcuuuaugugaagcucuaaccuuagcaaccgggcccaucucuacacugugggaaggaaauccaggaagauucuggaauacaacuauugcagugucaauggcuaacauuuuuagagggaguuaccuggccggagccggacuucucuuuucuaucaugaagaacacggccaauacaagaaggggaacuggcaacacaggagagacgcuuggagagaaauggaaaaaccgguugaaugcacuggggaagagugaauuccagaucuauaagaaaaguggaauccaggaaguggauagaaccuuagcaaaagaaggcaucaaaagaggagaaacggaccaucacgcugugucgcgaggcucggcgaaacugagaugguucgucgagagaaaccuggucacaccagaagggaaaguaguggaccuugguugcggcagggggggcuggucauacuauugugggggacuaaagaauguaaaagaagucaaaggccuaacaaagggaggaccaggacacgaagaacccauucccaugucaacauaugguuggaaucuggugcgucuacaaaguggaguugauguuuuuuuuacuccgccagaaaagugugacacauugcugugugacauaggggagucgucaccaaaccccacgguugaagcaggacgaacacucagaguucuaaacuuaguggaaaauuggcugaacaauaacacccaauuuugcauaaagguucucaacccauacaugcccucaguuauagaaaagauggaagcgcugcaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagacguugaccucggaaguggaacccgcaacaucggaauugaaagugagacaccaaauuuagacauaauugggaaaagaauagaaaaaauaaaacaggagcaugaaacaucauggcacuaugaccaagaccauccauacaaaacgugggccuaccauggcagcuacgaaacaaagcagacuggaucagcaucuuccauggugaacggagugguuaggcugcuaacaaaaccaugggacguuaucccuauggugacacagauggcaaugacagauacgacuccauuuggacaacagcgcguuuucaaagagaaaguggauacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaaguaaugcagccuuaggcgccauauucacugaugagaacaaguggaagucggcacgugaggcuguugaagacaguggauuuugggaauugguugauaaggaaaggaaucuccaucuugaaggaaagugugagacauguguauauaacaugaugggaaagagagaaaagaagcuaggggaguucgguaaagcgaagggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuugaaaaaugaagaaauggugacaaaccacauggaaggagaacacaagaaacuugcugaagccaucuucaaauuaacguaccaaaacaagguggugcgugugcaaagaccaacaccaaggggcacaguaauggacauuauaucgagaagagaccaaagagguaguggacaaguuguuaccuacggccucaauacuuucaccaacauggaagcccaacugaucagacagauggagggagaaggagucuucaaaagcauccagcaacugacagucacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggagcccucaagaggauggaacgauuggacacaagugccuuuuuguucacaccauuuccaugaguuaaucaugaaggacggucguguacucguaguuccaugcagaaaucaagaugaacugauugguagggcccgaauuucucagggagccgggugguccuugcgggaaacagccuguuuggggaagucuuacgcccaaauguggaaccugauguacuuccacagacgugaccuuaggcuggcggcaaaugccauuugcucggcagucccaucacacuggguuccaacaagucgaacaaccugguccauacacgccacacaugaguggaugacaacagaagacaugcugacagucuggaacaggguguggauucaagagaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaggaggaagaggcaggagucuugugguag

SEQ ID NO: 6996 - RNA, 9876 nt, Artificial Sequence
  derived and/or modified CDS sequence (wt) from DENV-2__JQ045670__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguucugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggagaggagcaugcggucggaaaugacacaggaaaacauggcaaggaaaucaaaguaacaccacagaguuccaucacagaagcagaauugacagguuauggcaccgucacgauggagugcuccccgaggacaggccuugacuucaaugagaugguguugcugcagauggaaaauaaagcuuggcuggugcauaggcaaugguuccuagaccugccauuaccauggcugcccggagcggauaaacaagagucaaauuggauacagaaagaaacauuggucacuuucaaaaauccccaugcgaagaaacaggauguuguuguucuagggucccaagaaggggccaugcauacagcacucacaggggccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagcuugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaaugugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauuuuagcggaaaaugaggugaaguugacuauuaugacaggagacaucaaaggaaucaugcaggcaggaaaacgaucuuugcggccucagcccacugagcuaaaguauucauggaaaacaugggguaaagcgaaaaugcucuccacagagucuuauaaccaaaccuuucucauugauggccccgagacggcagaaugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucaggaaaacucauaacagaauggugcugccgaucuugcacacuaccaccccuaagauacagaggugaagaugggugcugguacgggauggaaaucagaccauugaaagagaaagaagaaaaucugguuaacucccuggucacagccggacaugggcagguugacaauuuuucacugggagucuugggaauggcauuguucuuggaggaaaugcuuaggacccgaguaggaacgaaacaugcaauacuacuaguugcaguuucuuuugugacacugaucacagggaacauguccuucaaagaccuaggaagaguggugguuaugguaggcgcugcaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaacugacugacgcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuucugacauccucacagcaaaaaacggauuggauaccauuagcauugacaaucaagggucucaauccaacagcuauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggaagaucggcugauuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggugcuguucuaaugcauaaaggaaaaaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaauuaucgacaaaaaaggaaaaguugugggucuuuaugguaaugguguugucacaaggaguggagcauauguaagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacggggcuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccaggaaguagagauccauuuccucagagcaaugcaccaaucauggaugaagaaagagaaaucccugaacguucauggaauucuggacaugagugggucacggauuuuaaagggaagacuguuugguucguuccaagcauaaaagcaggaaaugacauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaucguuugagaggagaagcaaggaaaaccuuuguggacuuaaugaggagaggagacuuaccagucugguuggcuuacaaaguggcagcugaaggcaucaacuaugcagacagaaggugguguuuugaugggauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauucgcagccggaagaaagucucuaacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacuccuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaacugaccuacguugucauagccauccucacagugguggccgcaaccauggcaaacgagauggguuuccuagaaaaaacgaagaaggauuuuggauuaggaagcauugcaacccagcaacccgagagcaacauccuggacauagaccuacgucccgcaucagcuuggacgcuguaugccguggcuacaacauucgucacaccaaugcugagacauagcauugagaauuccucagugaauguaucccuaacagcuauagccaaccaagcaacaguguuaaugggucuagggaaaggauggccauugucaaagauggacaucggaguuccccuucucgccaucggauguuacucacaagucaaccccauaacucucacagcagcucuccucuuauugguagcgcauuaugccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggcuuuaaccuuagcuacagggcccaucuccacacugugggaaggaaauccaggaagguucuggaacacuaccauugcggugucaauggcuaacaucuuuagagggaguuacuuggcuggagcuggacuucucuuuucuauuaugaagaacacaaccaacacaagaaggggaacuggcaacauaggagagacgcuuggagagaaauggaaaagccgauugaacgcacugggaaaaagugaauuccagaccuacaagaaaaguggaauccaggaaguggauagaaccuuagcaaaagaaggcaucaaaagaggagaaacggaccaucacgcugugucgcgaggcucggcaaaacugagaugguucguugagagaaaccuggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaacugguugaacaacaacacucaauuuugcauaaaaguucucaacccauauaugcccucaguuauagaaaaaauggaagcacugcaaaggaaauacggaggagccuuagugaggaaugaucucucacgaaauuccacacaugagauguacuggguauccaaugcuucugggaacauagugucaucagugaauaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggagugguuaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaaacuaggggaauucggcaaggcaaaaggcagcagagccauaugguacauguggcuuggagcucgcuuccuggaguuugaagcccuaggauuccuaaaugaagaucacugguucucuagagagaacucccuaaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaauuaacguaucaaaacaagguggugcgcgugcaaaggccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugaucggcagagcccgaaucucccaaggagcaggguggucuuugcgggaaacggccuguuuggggaagucuuacgcccaaauguggaguuugauguauuuccacaggcgugaccucaggcuagcggcaaaugccauuugcucggcagugccaucacacuggguuccaacaagucggacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaaugguguggcucauugauuggguuaacaagcagggccacaugggcaaagaacauccaagcagcaauaaaucagguuagaucucuuauagguaaugaggaauacacagauuacaugccauccaugaaaagauucagaagagaagaggaagaagcaggaguccugugguaa

SEQ ID NO: 6997 - RNA, 9876 nt, Artificial Sequence
  derived and/or modified CDS sequence (wt) from DENV-2__JQ045686__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacuuacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcaguaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuggaacauggaagcugugugacgacgauggcaaaaaacaaaccaacguuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaaggggggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggccaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaggagucaaauuggauacagaaagaaacauuggucacuuucaaaaauccccaugcgaagaaacaggacguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagcuugggacuuuggaucccuaggaggaguguucacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucauuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuauaacaggagacaucaaaggaaucaugcaggcaggaaaacgaucuuugcggccucagcccacugagcuaaaguacucauggaaaacaugggguaaagcaaaaaugcucuccacagagucuuauaaucaaaccuuucucauugauggccccgagacggcagagugccccaacacaaauagagccuggaacucguuggagguugaagacuacggcuuuggaguguucaccaccaauauauggcuaaaauugaaagaaaaacaggaugcauucugcgacucaaaacucaugucggcggcuauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuuaauuucugugauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccacugaaagagaaagaagaaaaucugguuaacucuuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaauauguccuucaaagaccuaggaagaguggugguuaugguaggcgcuacaaugacggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaacugacugacgcguuagccuuaggcaugaugguccuuaaaauaguaagaaacauggaaaaguaucaauuagcagugacuaucauggcuaucuugugcgucccaaacgcagugauauuacagaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggggggcuccucacugugugcuacgugcucacuggaagaucggcugauuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacuuauuagaacaggauugcuggugaucucaggacuuuuuccuauaucaauaccaaucacggcagcggcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaacccggucuuuucaaaacuaacaccggaacaauaggagcuguaucccuggacuuuuccccuggaacgucaggaucuccaaucaucgacaaaaaaggaaaaguugugggucuuuaugguaaugguguugucacaaggaguggagcauaugugagcgccauagcccaaacugaaaaaagcauugaagacaaccccgagauugaagaugacauuuuccgaaagagaagacugaccaucauggaccuccacccaggagcgggaaagacgaaaagauaccuuccagccauagucagagaagccauaaaacgggguuugagaacguuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugacauagcagcuugccugagaaaaaauggaaagaaaguaauacaacuuaguaggaagacuuuugauucugaguaugucaagacuagaaccaaugauugggauuucguggucacgacagacauuucagaaaugggugccaauuucaaagcugagaggguuauagaccccagacgcugcaugaaaccagucauacuaacagauggugaggagcgggugauucuggcaggacccaugccagugacccauucuagugcagcacaaagaagagggagaauaggaagaaauccaaaaaaugaaaaugaccaguacauauacaugggagaaccucuggaaaaugaugaagacugcgcacacuggaaagaagccaaaaugcuccuagacaacauuaacacaccagaaggaauuauuccuaguauguuugaaccagagcgugaaaaaguggaugccauuguuggugaauaccgcuugagaggagaagcaaggaaaacguuuguggacuuaaugaggagaggagacuuaccagucugguuggcuuacaaaguggcagcugaaggcauuaacuaugcagacagaaggugguguuuugauggaauuaagaacaaccaaauccuggaagaaaauauggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacuuucaugacucagaagacaagagacgcacuggacaaccuagcagugcugcacacggcugaagcagguggaagggcguacaaucaugcucucagugaacugccggagacccuagagacacugcuuuuacugacgcuacuggcuacagucacaggagggaucuuuuuauucuugaugaguggaaggggcauagggaagaugacccugggaaugugcugcauaaucacggcuagcauccuucuaugguacgcacaaauacagccacacuggauagcagcuucaauaauacuggaguuuuuucuuauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccaacaacccgagagcaacauccuggacauagaccuacgucccgcaucagcuuggacgcuguaugccguggcuacaacauuuguuacaccaaugcugagacauagcauugagaauucuucagugaauguauccuuaacagcuauagccaaccaagcgacaguguuaaugggccuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaguccucugugugacucaaguauugaugaugaggacuacaugggcucugugugaggccuuaaccuuagcuacagggcccaucuccacacugugggaaggaaauccaggaagguucuggaacacuaccauugcggugucaauggcuaacauuuuuagagggaguuacuuggcuggagcuggacuucucuuuuccauuaugaagaacacaaccaauacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaauguaagagaagugaaaggccuaacaaaaggaggaccaggacacgaagaacccaucccuaugucaacauauggguggaaucuggugcgccuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauacggaggagccuuagugagaaauccacucucacgaaauuccacacacgagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugagauaccaaaccuagacauaauugggaaaagaauagaaaaaauaaagcaagagcaugaaacaucauggcacuacgaccaagaccacccauacaaaacgugggcauaucaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaggaucacugguucucuagagagaacucccugaguggaguggaaggagaagggcugcacaagcuagguuacauucuaagagaugugagcaagaaagagggaggagccauguacgccgacgacacagcaggaugggacacaagagucacacuagaagaccuaaaaaaugaagaaaugguaacaaaucauauggaaggagaacauaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuuuaccaauauggaagcccaauuaaucagacagauggagggagaaggagucuuuaaaaacauccagcaccugacagucacagaagaaguugccgugaaaaacugguuggcaagaguggggcgugaaagguugucaagaauggccaucaguggagaugauuguguugugaaaccuuuagaugacagguucgcaaacgcuuugacagcccuaaaugacaugggaaagauuagaaaagauauacaacagugggaaccuucaagaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaaaucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugaucggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguag

SEQ ID NO: 6998 - RNA, 9876 nt, Artificial Sequence
  derived and/or modified CDS sequence (wt) from DENV-2__KU094070__SS-prME
acugcaggcaugaucauuaugcugauuccaacagugauggcguuccauuuaaccacacguaacggagaaccacacaugaucgucaguagacaagagaaagggaaaagucuucuguuuaaaacagaggauggugugaacauguguacccucauggccauggaccuuggugaaugguuggaagacaaaaucacguacaaguguccucuucucaggcagaaugaaccagaagacauagauuguuggugcaacucuacguccacauggguaacuuaugggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacagaagccaaacaaccugccacucuaaggaaguacuguauagaggcaaagcugaccaacacaacaacagaaucucgcugcccaacacaaggagaacccagccuaaaugaagagcaggacaaaagguucgucugcaaacacuccaugguggacagaggauggggaaauggauguggauuauuuggaaaaggaagcauugugaccugugcuauguucacaugcaaaaagaucaugaaaggaaaagucgugcaaccagaaaacuuggaauacaccauugugauaacaccucacucaggggaagagcaugcagucggaaaugacacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaaaauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggauacuuacuguucacaggacaucucaagugcaggcugaggauggacaaacuacagcucaaaggaaugucauacucuaugugcacaggaaaguuuaaaguugugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacagaaaaagauagcccagucaacauagaagcagaaccuccauucggagacagcuacaucaucauaggaguagagccgggacaauugaagcucaacugguuuaagaaaggaaguucuaucggccaaauguuugagacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggacuaugaaaauccucacaggagucauuaucacauggauaggaaugaauucacgcagcaccucacugucugugucacuaguauuggugggagccgugacgcuguauuugggaguuauggugcaggccgauagugguugcguugugagcuggaaaaacaaagaacugaaguguggcagugggauuuucaucacagacaacgugcacacauggacagaacaauacaaguuccaaccagaaucuccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcggccccagcccacugagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaagagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggaguaauggagugcuagaaagugagaugauaauuccaaagaauuucgcuggaccagugucacaacacaacuacagaccaggcuaccauacacaaacagcaggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguccuuaaaauggugagaaaaauggaaaaguaucaauuggcagugacuaucauggcuaucuugugcgucccaaaugcagugauauuacaaaacgcauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuguaucaauaccaaucacggcagcagcaugguaccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacgcggcgcuguucuaaugcauaaaggaaagaggauugaaccaucaugggcggacguuaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaaguauugaagacaauccagagaucgaagaugacauuuuucgaaagagaaaauugaccaucauggaccuccacccaggagcgggaaagacgaagagauaccuuccggccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaaaagcaggaaaugauauagcagcuugccugagaaaaaauggaaagaaagugauacaacucaguaggaagaccuuugauucugaguaugucaagacuagaaccaaugauugggacuucguggucacaacugacauuucagaaaugggugccaacuucaaggcugagaggguuauagaccccagacgcugcaugaaaccaguuauacuaacagauggugaagagcgggugacccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcagugcugcacacggcugaagcagguggaagggcguacaaucaugcucucagugaacugccggagacccuggagacauugcuuuuacugacacuucuggcuacagucacgggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccagcaacccgagagcaacauccuggacauagaucuacgucccgcaucagcauggacgcuguaugcuguggccacaacauuugucacaccaauguuaagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacugucgauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuuuagagggaguuacuuggccggagcuggacuucucuuuuccaucaugaagaacacaaccaacacgagaaggggaacuggcaacauaggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaaucuggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuacgagccagauguagaccucggaagcggaacccgcaacaucggaauugaaagugagauaccaaaccuagacauaaucgggaaaagaauagaaaaaauaaaacaagagcaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguauaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacuccuugaguggaguggaaggagaagggcugcacaagcuagguuacauuuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagggaccaaagagguaguggacaaguugguaccuauggacucaauacuuucaccaauauggaagcccaacuaaucagacagauggagggagaaggaguuuucaaaagcauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccaaggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuugggaaaaagagaagaccaauggugcggcucauugauugggcuaacaagcagggucaccuggggcaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6999 - RNA, 9876 nt, Artificial Sequence
  derived and/or modified CDS sequence (wt) from DENV-2__FM210215__SS-prME
ucugcaggcaugaucguuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacucuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucgaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucaccggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugcuuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccagccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuacaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugucgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaagaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugguauuacaaaaugcauggaaagugaguugcacaauacuggcagugguguccguuuccccacugcuuuugacauccucacagcaaaaaacggauuggauaccauuagcauugacaaucaagggucucaauccaacagccaucuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagaaagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucaaagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacucaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacauugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaauauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacucacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaagcguaagagaagugaaaggucuaacaaaaggaggaccaggacacgaagaacccauuccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauuggcugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccugggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaauuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaacuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 7000 - RNA, 9876 nt, Artificial Sequence
  derived and/or modified CDS sequence (wt) from DENV-2__FM210216__SS-prME
ucggcaggcaugaucauuaugcugauuccaacagugauggcguuccaucugaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggguucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacgcuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcgaagagaauggccauuuugggugacacagccugggacuuuggaucccugggaggaguguuuacaucuauaggaaaagcucuccaccaagucuuuggagcaauuuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacgacagagugcccuaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaaccacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacacgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcaguuggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacucccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaaguauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcgcacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggauuuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccguugauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuuuuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccuggucuauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 7001 - RNA, 9876 nt, Artificial Sequence
  derived and/or modified CDS sequence (wt) from DENV-2__FM210217__SS-prME
acagcaggcgugauuauuauguuaauuccaacagcgauggcguuccauuuaaccacacguaauggagaaccacacaugaucguuggcagacaagagaaagggaaaagucuucuguuuaaaacagaggauggugugaacauguguacccucauggccauugaucuuggugaauugugugaagauacaaucacguacaagugcccccuccucaggcagaaugaaccagaagauauagauuguuggugcaacuccacguccacauggguaacuuaugggacguguaccaccacaggagaucacagaagagaaaaaagaucaguggcacucguuccacauguggguaugggacuggagacacgaacugaaacauggaugucgucagaaggggccuggaaacacgcucagagaauugaaaccuggauuuugagacauccaggcuuuaccauaauggcagcaauccuggcauacaccguaggaacgacacauuuccaaagggcccugauuuucaucuuacuggcagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacugaagccaaacaaccugccacucuaaggaaguacuguauagaggcaaagcugaccaauacaacaacagaaucucguugcccaacacaaggggaacccagucuaaaugaagagcaggacaaaagguucgucugcaaacacuccaugguagacagaggauggggaaauggauguggauuauuuggaaagggaggcauugugaccugugcuauguucacaugcaaaaagaacauggaaggaaaaaucgugcaaccagaaaauuuggaauacaccauugugauaacaccucacucaggagaagagcacgcuguagguaaugacacaggaaaacaugguaaggaaauuaaaauaacaccacagagucccaucacagaagcagaacugacaggcuauggcacagucacgauggagugcucuccgagaacgggccucgacuucaaugagauggugcugcugcagauggaagauaaagcuuggcuggugcacaggcaaugguuccuagaccugccguuaccauggcuacccggagcggacacacaaggaucaaauuggauacagaaagagacacuggucaccuucaaaaauccccacgcgaagaaacaggaugucguuguuuuaggaucucaagaaggggccaugcacacggcacucacaggggccacagaaauccagaugucaucaggaaacuuauuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauuuggagacagcuacaucauuauaggaguagagccgggacaauugaaacucaacugguucaagaaaggaaguuccaucggccaaauguuugagacaacaaugagaggagcaaagagaauggcuauuuuaggugacacagccugggauuuuggaucucugggaggaguguuuacaucuauaggaaaggcucuccaccaaguuuuuggagcaaucuauggggccgcuuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguuguaagcuggaaaaacaaagaacugaaauguggcagcgggaucuucaucacagauaacgugcauacguggacagaacaauacaaguuccaaccagaauccccuucaaaauuagcuucagcuauccaaaaagcucaugaagaggguauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucccacaaccagaccuuucucauugauggcccugaaacagcagagugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaaguuaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggacggaugcugguaugggauggaaaucagaccauuaaaagagaaagaagagaauuuggucaacucccuggucacagccggacaugggcagauugacaacuuuucacuaggagucuugggaauggcacuauuccuggaagaaaugcucaggacacgaguaggaacgaaacaugcaauacugcuaguugcaguuucuuuugugacauugaucacugggaacauguccuuuagagauuugggaagaguaaugguuauggugggcgcugccaugacggaugacauagguauaggagugacuuaucuugcccuacuggcagcuuucaaaguaagaccaacuuuugcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugaccaucauggccaucucgugugucccaaaugcagugauacugcaaaacgcauggaaggugagcugcacaauauuggcaacgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuugaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggaaguccaaguccuagcauuggaaccugggaaaaauccaagagcuguccaaacgaaaccuggacuuuucaaaaccaacaccggaaccauaggcgccguaucuuuggacuuuuccccuggaacgucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguugagaugggugaggcagcugggauuuucaugacagccacuccuccgggaaguaaagacccauuuccucagagcaaugcaccgaucauggaugaggaaagagaaaucccugagcguucguggaacucuggacaugaaugggucacggauuuuaaggggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacgcugcaugaaaccaguuauauuaacagauggcgaagagcgggugaucuuggcaggacccaugccaguaacccacucuagugcagcgcaaagaagagggagaauagggagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucugguuggcuuacagaguggcagcugaaggcaucaacuaugcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuagauaaccuagcugugcugcauacggcugaggcagguggaagggcguacaaucaugcucucagugaacugccggagacccuugagacacuacuuuuacugacacuccuggcuacagucacgggaggaauuuucuuauucuuaaugaguggaaaagguguagggaagaugacccugggaaugugcugcauaauaacggcuagcauccuccuauggcaugcacagauacaaccacacuggauagcagcuucaauaauauuggaguuuuuucucauaguuuugcucauuccagagccagaaaaacagagaacaccccaagauaaccaacugaccuacguugucauagccauccuuacagugguggccgcaaccauggcaaacgagauggguuuccuggaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaacuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuucaagcgaaagcaacuagagaagcucagaaaagagcagcagcaggcaucaugaaaaacccaacagucgauggaauaacagugauugaccuagauccaauacccuaugacccaaaauuugaaaaacagcuaggacaaguaaugcuccugauucucugcgugacucaaguauuaaugaugaggacuacaugggcuuugugugaggcucuaaccuuagcgaccgggcccaucuccacauugugggaagguaauccagggagguuuuggaacacuacuauugcagugucaauggcuaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauuguggaggacuaaagaauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucgucagugaacaugaucucaaggaugcugauuaacagauucacaaugaaacacaagaaagccaccuacgagccagauguugaccuagggagcggaacccgcaacauuggaauugaaagugagauaccaaaucuagacauaauaggaaagagaauagagaaaauaaaacaagagcaugaaacaucauggcacuaugaccaggaccacccauacaaaacaugggcuuaccaugguagcuaugaaacaaaacagacuggaucagcaucauccauggugaacggaguggucagacugcugacaaaaccuugggacgucgucccuaugguaacacagauggcaaugacagacacgacuccauuuggacaacagcguguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagcuuugggggccauauucacugaugagaacaaauggaagucggcacgcgaggcuguugaagauaguagguuuugggagcugguugacaaggaaagaaaucuccaucuugaagggaagugugaaacauguguguacaacaugaugggaaagagagaaaagaaacuaggggaguucggcaaggcaaaagguagcagagccauaugguacauguggcuuggagcacgcuucuuggaguuugaagccuugggauucuugaaugaggaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucggcaccuauggccuuaacacuuucaccaauauggaagcccaacuaauuagacagauggagggagaaggaauuuucaaaagcauucagcaccugacagccacagaagaaaucgcugugcagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuccaugaguuaaucaugaaagauggucgcgugcucguaguuccaugcagaaaccaagaugaacugaucggcagggcccgaauuucccagggagcuggguggucucugaaggagacggccuguuuggggaagucuuacgcucaaauguggagucugauguacuuccacagacgugaccucaggcuggcggcaaacgccauuugcucggcagucccgucacauuggguuccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 7002 - RNA, 9876 nt, Artificial Sequence
  derived and/or modified CDS sequence (wt) from DENV-2__JX286524__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacauccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagcuaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaauuuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucauaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguguuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaguuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguaugggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaaucuuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcagagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugacggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucacgcucucagugaacucccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugacuuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacucuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggauuaaagaaugugagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaauuacggcugaguggcuuuggaaagaacuaggaaaggaaaagacaccuagaauguguaccagagaagaauucacaagaaaagugagaagcaaugcagccuugggagccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaacacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 7003 - RNA, 9876 nt, Artificial Sequence
  derived and/or modified CDS sequence (wt) from DENV-2__JX286520__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcauugucacgauggagugcucuccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaacccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacuggaaaguuuaaaaucgugaaggaaauagcagaaacacaacauggaacaauaguuaucagaguacaauaugaaggggacggcucuccauguaagauccccuuugagauaacagauuuggaaaaaagacacgucuuaggacgccugauuacaguuaacccaaucguaacagaaaaagauagcccagucaacauagaagcagaacccccauucggagacaguuacaucaucgugggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagccauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggugcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagcuauuuuuuuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuaggacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaaucaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggcagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagacuucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuggaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacuaugggaaggaaauccagggagauuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuuuuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcucuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 7004 - RNA, 9876 nt, Artificial Sequence
  derived and/or modified CDS sequence (wt) from DENV-2__JX286525__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacauccacauggguaacuuaugggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcauaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaauuuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucauaaucagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguguuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaguuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguaugggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaaucuuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccaaucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcagagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugacggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucacgcucucagugaacucccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguggauagaacucuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggauuaaagaaugugagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaauuacggcugaguggcuuuggaaagaacuaggaaaggaaaagacaccuagaauguguaccagagaagaauucacaagaaaagugagaagcaaugcugccuugggagccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuuuuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagugggcaagucgguaccuauggccuuaacacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 7005 - RNA, 9876 nt, Artificial Sequence
  derived and/or modified CDS sequence (wt) from DENV-2__KM279598__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcuauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacgcuggauuuugaacugauaaaaacagaagccaaacaucucgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguaguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggacgcuugauuaccgucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaacccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauguggggagagugauggucauggugggcgcuacuaugacggaugacauaggcaugggcgugacuuaucuugcccuauuagcagccuuuaaaaucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucuuaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucaccggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagcccggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuauuagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaaaagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaagggaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuagccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacccaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuucuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacaugcguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuugaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7006 - RNA, 9876 nt, Artificial Sequence
  derived and/or modified CDS sequence (wt) from DENV-2__KM279576__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcuauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacgcuggauuuugaacugauaaaaacagaagccaaacaucucgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuacggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguaguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguuccccgugcaagaucccuuuugaaauaauggacuuggaaaaaaggcaugucuuaggacgcuugauuaccgucaacccaauugucacagaaaaagacagcccagucaacauagaagcagaaccuccauuuggagacaguuacaucauuauaggaguagaaccaggacaacugaagcuuagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugggugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaacccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuuuaaaaucagaccaaccuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucuuaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucaccggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagcccggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuauuagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaaaagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaagggaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaauccuggaagaaaauguggaaguagaaauuuggacaaaagaaggagaaaggaagaaauuaaaacccagaugguuggaugcuaggaccuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuagccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugccaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacccaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggacagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgccuucaaaguggaguugauguuuucuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucuuaacccauacaugcccucaguuauagaaaaaauggaagcacuacaaaggaaauacggaggagcuuuggugaggaauccacucucacgaaauuccacacacgagauguacuggguauccaaugcuuccgggaauauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacaugcguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuugaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauuggcagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7007 - RNA, 9876 nt, Artificial Sequence
  derived and/or modified CDS sequence (wt) from DENV-2__KC964095__SS-prME
ucugcaggcaugauuauuaugcugauuccaacaguaauggcguuccaucuaaccacacgcaacggagaaccacacaugaucgucaguauacaagagaaagggaaaagucuucuguuuaagacugaggauggcgugaacaugugcacccucauggccauggaccuuggugaauugugugaagacacaaucacguacaaguguccccuucuaaggcagaaugagccagaagacauagaccguuggugcaauuccacguccacauggguaaccuaugggacuuguaccaccacgggagaacauagaagagaaaaaagaucaguggcacuuguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuccaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguuguccaacacagggggaacccagccuaaaagaagagcaggauaagagguucgucugcaaacacuccauaguagacagaggguggggaaauggauguggaucauuuggaaagggaggcauugugaccugugcuauguucacaugcaagaagaacauggaagggaaaaucgugcaaccagaaaacuuggaauacaccauugugguaacaccucacucaggggaagagcaugcgaucggaaaugacacaggaaaacauggcaaggaaaucaaaguaacaccacagaguuccgucacagaagcagaauugacagguuauggcaccgucacgauagagugcucuccgagaacaggccucgacuucaaugagaugguguugcugcagaugggaaauaaagcuuggcuggugcauaggcaaugguuccuagaccugccguuaccauggcugcccggagcggacacacaagggucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuuacucuucaccggacaucucaagugcgggcugagaauggacaagcuacagcucaaaggaaugucauacuccaugugcacgggaaaguucaaaguugugaaggaaauagcagaaacacaacauggaacgauaguuaucagagugcaauaugaaggggacggcucuccauguaaaaucccuuuugagauaauggauuuggaaaagagauaugucuuaggccgccugaucacagucaacccaauugugacagaaaaagauagcccagucaacauagaagcagaaccuccauucggugacagcuacaucaucauaggaguagagccgggacaacugaagcucaacugguucaagaaaggaaguucuaucggccaaauguuugagacaacaaugaggggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcaccucacugucugugucacuaguauugguaggaauugugacacuguacuugggagucauggugcaggccgauagugguugcguugugagcuggaaaaacaaagaacugaaauguggcagugggauuuucaucacagacaacgugcgcacauggacagaacaauacaaguuccaaccagaauccccuucaaaacuagcuucagcuauccagaaagcucaagaagagggaauuugugggauccgcucagugacaagauuggagaaccuaauguggaaacaaauaacaccagaauugaaucacauucuagcagaaaaugagguaaaauuaacuaucaugacaggagacaucaaaggaaccaugcaggcaggaaaacgaucucugcggccucagcccacugagcuaaaguauucauggaaaacauggggcaaagcaaaaaugcucuccacagagucucauaaccaaaccuuucuuauugauggccccgaaacagcagaaugccccaacacaaauagagcuuggaacucguuggagguugaagacuacgguuuuggaauguucaccaccaauauauggcuacaauugaaagaaaaacaggaugcauucugcgacucaaaacucaugucagcggccauaaaagacaacagagccguccaugccgacauggguuauuggauagaaagugcacucaaugacacauggaagauagagaaagcuucuuucauugaaguaaaaaacugccacuggccaaagucacacacccucuggaguaauggagugcuagaaagugagaugauaauuccaaagaaucucgcuggaccagugucucaacacaacuauagaccaggcuaucauacacaaauagcaggaccauggcaucaagguaagccugagauggacuuugauuucugcgauggaaccacagugguagugacugaggacugcggaaauagaggacccucuuuaagaacaacuacugccucuggaaaacucauaacagaauggugcugccgaucuugcacauuaccaccccuaagauacagaggugaggaugggugcugguacgggauggaaaucagaccguugaaagagaaagaagaaaauuugguuaacuccuuggucacagccggacaugggcagauugacaauuuuucacuaggagucuugggaauggcauuguuccuggaggaaaugcuuaggacccgaguaggaacgaaacaugcaauacuacuaguugcaguuucuuuugugacauugaucacagggaacauguccuuuaaagaccuaggaagaguggugguuauggugggcgccaccaugacggaugauauagguaugggcguaacuuaucuugcccuacuagcagccuucaaagucagaccgacuuuugcagcuggacuacucuugagaaaacugaccuccaaggaauugaugaugacuaccauaggaauuguacuccucucccaaagcacuauaccagagaccguucuugaauugacugaugcgcuagccuuaggcaugauggcccucaaaauaguaagagacauggaaaaguaucaauuagcagugacuaucauggcuaucuugugcgucccaaacgcagugauauugcagaaugcauggaaagugaguugcacaauacuagcagugguauccguuuccccacugcuuuugacauccucacagcaaaaaacggauuggauaccauuagcauugacaaucaagggucucaauccaacagccauuuuucuaacaacucucucaagaaccaacaagaaaaggagcuggccacuaaaugaggcuaucauggcagucggaauggugagcauuuuagccaguucucuccuaaaaaaugauauucccaugacaggaccacuaguggcuggagggcuccucacugugugcuaugugcucacuggacgaucggccgacuuggaacuggagagagcaacugaugucaauugggaagaucaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccuaugggaaguaaagaaacaacgggccggaguauugugggauguuccuucacccccacccaugggaaaggcugaacuggaagauggagccuacagaaucaagcaaaaagggguucuuggguauucccagaucggagcuggaguuuauaaagaaggaacauuccauacaauguggcaugucacacguggcgccguccuaaugcauaaaggaaagaggauugaaccaucaugggcggacgucaaaaaagaucuaauaucauauggaggaggcuggaagcugggaggagaauggaaggaaggagaagaaguccaggugcuggcacuggagccuggaaaaaauccaagagccguccaaacaaaaccuggucuuuucaagaccaacacuggaacaauaggugccguaucucuggacuuuuccccuggaacgucaggaucuccaaucauugacaaaaaaggaaaaguugagggucuuuaugguaaugguguugucacaaggagcggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacauuaauccuggcccccacuagaguuguggcggcugaaauggaagaagcucucagaggacuuccaauaagauaccaaacccccgccaucagagcugagcacacagggcgggaaauuguggaucuaaugugucacgccacauuuaccaugaggcugcuaucaccaguuagagugccaaacuacaaccugauuaucauggaugaagcccauuucacagacccagcaaguauagcagcuagaggauacaucucaacucgaguggagaugggugaagcagcugggauuuuuaugacagccacuccuccgggaagcagagauccauuuccucagagcaaugcaccaaucauagaugaagaaagagaaaucccugaacguucauggaauucuggacaugagugggucacggauuuuaaagggaagacugucugguucguuccaagcauaaaagcagggaaugauauagcagcuugccugagaaaaaauggaaagaaagugauacaacuuaguaggaagacuuuugauucugaguaugucaagacuagaaccaaugauugggauuucgugguuacaacugacauuucagaaaugggugccaauuucaaggcugagaggguuauagaccccagacgcugcaugaaaccagucauacuaacagauggugaggagcgggugauucuggcgggaccaaugccagugacccacucuagugcagcgcaaagaagagggaggauaggaagaaauccaaaaaaugaaaaugaccaguacauauacaugggggaaccucuggaaaaugaugaagacugugcacacuggaaagaagccaaaaugcuccuagauaacauuaacacaccagaaggaaucauucccaguauguuugaaccagagcgugaaaagguggaugccauugauggcgaauaccgcuugagaggagaagcaaggaaaaccuuuguggaccuaaugagaagaggagaccuaccagucugguuggccuacaaaguggcagcugaaggcaucaacuaugcagacagaaggugguguuuugauggaaucaagaacaaccaaauccuggaagagaauguagaaguugaaaucuggacaaaagaaggggaaaggaagaaauugaaacccagauggcuggaugcuaggaucuacucugacccacuggcgcuaaaagaauucaaagaauuugcagccggaagaaagucucugacccugaaccuaauuacagaaauggguaggcuuccaacauucaugacucagaagacuagagacgcacuggacaacuuagcagugcugcacacggcugaggcagguggaagggcguacaaucaugcucucagugaacugccggagacccuggagacacugcuuuuacugacacuucuggcuacagucacgggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuauguugucauagccauccucacagugguggccgcaaccauggcaaacgagauggguuuccuagaaaaaacgaagaaagaucuuggauuaggaagcaucacaacccagcaacccgagagcaacauccuggacauagaucuaccccccgcaucagcauggacgcuguaugccguggcuacaacauuuguuacaccaaugcugagacauagcauugagaauuccucagugaauguaucccuaacagccauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccauuauagggccaggacuucaagcaaaagcaaccagagaagcucagaaaagagcagcggcgggcaucaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggcccaucuccacacugugggaaggaaauccaggaagguucuggaacacuaccauugcggugucaauggcuaacaucuuuagagggaguuacuuggcuggagcuggacuucucuuuuccauuaugaagaacacaacuaacacaagaaggggaacuggcaacauaggagagacgcuuggagagaaauggaaaagccgauugaacgcacugggaaaaagugaauuucagaucuacaagaaaaguggaauccaggaaguggauaggaccuuagcaaaagaaggcaucaagagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccugacaaaaggaggaccaggacacgaagaacccauccccaugucaacauauggguggaaucuagugcgucuucaaaguggaguugacguuuucuucaucccgcccgaaaagugugacacauugcugugugacauaggggaguggucaccaaacccuacaguggaagcaggacgaacacucagaguccuuaauuuaguagaaaauugguugaacaacaacacucaauuuuguauaaaaguccucaacccauauaugcccucaguuauagaaaaaauggaaacacugcaaaggaaauauggaggagccuuagugagaaauccacucucacggaacuccacacaugagauguacuggguauccaacgcuuccgggaacauagugucaucagugaacaugauuucaaggauguugaucaacagauucacaaugagacauaagaaagccacauacgagccagacguugaccucggaagcggaacccgcaacaucggaauugaaagugagacaccaaauuuagacauaauugggaaaagaauaggaaaaauaaaacaagagcaugaaacaucauggcacuaugaccaagaccacccauacaaaacgugggccuaccauggcagcuacgaaacaaaacagacuggaucagcaucauccaugguggacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaagagacaccuaggaugugcaccagagaagaauucacaagaaaggugagaagcaaugcagccuuaggugccauauucacugaugagaacaaguggaagucggcacgugaggcuguugaagauaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcuacacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaccaccaagaggcacaguaauggacauuauaucgagaagagaccaaagagguaguggacaaguugucaccuacggccucaauacuuucaccaacauggaagcccaacugaucagacagauggagggagaaggaguuuuuaaaaauauucagcaccugacagucacagaagaaaucgccgugcaaaacugguuagcaagaguggggcgcgaaagguuaucaagaauggccaucaguggagaugauuguguugugaaaccuuuagaugacagauucgcaagcgcuuugacagcucuaaaugacgugggaaagauuagaaaagacauacaacaaugggaaccuucaagaggaugggacgauuggacacaagugcccuucugcucacaccauucccaugagcuaaucaugaaggauggucguguacuuguuguuccaugcagaaaccaggaugaacugauuggcagagcccgaaucucccaaggagcaggguggucuuugcgggagacggcuuguuuggggaagucuuacgcccaaauguggagcuugauguauuuccacagacgcgaccucagguuggcggcaaaugccauuugcuccgcagugccaucacauuggguuccaacaagccgaacaaccuggucuauacacgccaaacaugaauggaugacaacggaagacaugcugacagucuggaauaggguguggauucaggaaaacccauggauggaagacaaaaccccaguggaaucaugggaggaaaucccauacuuggggaaaagagaaggccaaugguguggcucguugauuggguuaacaagcagggccacaugggcaaagaacauccaaacagcaauaaaucaaguuagaucucuuauaggcaaugaggaauacacagauuacaugccauccaugaaaagauucagaagagaagaggaagaagcaggaguccugugguag

SEQ ID NO: 7008 - RNA, 9876 nt, Artificial Sequence
  derived and/or modified CDS sequence (wt) from DENV-2__KC964094__SS-prME
ucugcaggcaugauuauuaugcugauuccaacaguaauggcguuccaucuaaccacacgcaacggagaaccacacaugaucgucaguauacaagagaaagggaaaagucuucuguuuaagacugaggauggcgugaacaugugcacccucauggccauggaccuuggugaauugugugaagacacaaucacguacaaguguccccuucuaaggcagaaugagccagaagacauagacuguuggugcaauuccacguccacauggguaaccuaugggacuuguaccaccacgggagaacauagaagagaaaaaagaucaguggcacuuguuccacaugugggaaugggacuggagacgcgaaccgaaacauggaugucaucagaaggagccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguaguauaggaauaucaaauagagacuuuguggaagggguuucaggaggaagcuggguugacguagucuuagaacauggaagcugugugacgacgauggcgaaaaauaaaccaacauuggauuuugaacugacaaaaacggaagccaaacaucccgccacuuuaaggaaauauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaaaguaacaccacagaguuccgucacagaagcagaacuaacaggcuauggcacugucacgauggaaugcucuccgagaacgggccucgacuucaaugagaugguguugcugcaaaugaaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguuguuguuuuaggaucccaagaaggggcuaugcauacagcacucacaggggccacggaaauccagaugucaucaggaaacuuacuguucacaggacaucuuaagugcaggcugagaacggacaaacuacagcucaaaggaaugucauauucuauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaauuguuacagaaaaagacagcccagucaacauagaagcagaaccuccauucggagacagcuacaucauuauaggaguagaaccgggacaacugaagcucagcugguuuaagaaagaaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacgcaguaccucacugucugugucacuaguauuagugggggucgugacauuguauuugggaguuauggugcaggccgauagugguugcguugugaguuggaaaaacaaagaacugaaauguggcagugggauuuuugucacagacaacgugcacacauggacagaacaauacaaauuccaaccagaauccccuucaaagcuggcuucagcuauccagaaggcucaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaacgucccaacacaaacagagcuuggaacucacuagaaguugaagacuauggcuuuggaguauucaccaccaacauauggcugaaauugaaagaaaggcaggauguauuuugugacucaaaacucaugucagcagccauaaaagacaacagagccguccacgccgauauggguuauuggauagaaagcgcacucaaugacacauggaagauugagaaagccucuuuuauugaaguuaaaagcugccacuggccaaagucacacacucucuggaguaauggaguguuagaaagugagaugauaauuccaaagaauuuugcaggaccagugucacaacacaauuacagaccaggcuaucauacacaaacggcaggacccuggcaucuagguaggcuugagauggacuuugauuucugcgaaggaaccacagugguagugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaaucguacuccucucucagagcaccauaccagagaccauacuugaacugacugacgcguuggcucuggggaugaugguucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucgcuggaagaucggcugauuuggaacuggagagagcugcugacguaagaugggaagaacaggcagagauaucaggaaguagcccaauucugucaauaacaauaucggaagaugguggcaugucgauaaaaaaugaagaagaagaacaaacacugacuauacucauuagaacaggacugcuggugauaucaggacucuuucccgugucaauaccaaucacggcagcugcaugguaccugugggaagugaaaaaacaacgagccggaguauugugggaugucccuucacccccaccugugggaaaggccgaacuggaagauggagccuauagaaucaagcagaaagggauucuaggauacucgcagaucggagccggaguuuacaaagaaggaacauuccacacaauguggcacgucacacguggugcuguccuaaugcauaaagggaagagaauugaaccaucaugggcggacgucaagaaagaccuaauaucguauggaggaggcuggaagcuagaaggagaauggaaggaaggagaagaaauccagguccuggcauuagagccuggaaagaauccaagagccguccaaacaaaacccggucuuuuuaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcaucgaagacaauccagagaucgaagaugacaccuuucgaaagaaaagauugaccaucauggaccuccacccaggagcgggaaaaacaaagagauaccuuccagcaauagucagagaagccauaaaacgaggcuugagaacacuaauccuggcccccacuagaguuguagcggcugaaauggaagaagcucucagaggacuuccaauaagguaccaaaccccagcuaucagagcugagcacacugggcgggagauuguggaucuaaugugucacgccacauuuaccaugaggcugcuaucaccaauuagagugccaaauuacaaccugaucaucauggaugaagcccauuucacagacccagcaagcauagcagcuagaggauacauuucaacucgaguagagaugggugaagcagcugggauuuucaugacagcuacuccuccuggaagcagagacccauuuccucagagcaaugcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaggaaagugauacaacucagcaggaagaccuccgauucugaauauaucaagacuaggaccaaugauugggacuuuguggucacgacagacauuucagaaaugggugcuaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggaugccauugauggugaauaccgcuugagaggagaagcgaggaaaacuuuuguggaccuaaugagaagaggagaccuaccagucuggcuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaaugcacuggacaacuuagcaguccugcauacggcugaagcaggcggaagggcguacaaucaugcucuuagugaacugccggagacccuggagacauugcuuuuacugacacuuuuggccacagucacgggcggaaucuuccuguucuugaugagcggaaaggguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaagcauugcaacgcagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacggcagcccuucucuuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaacccuagcgaccgggcccaucucuacacugugggaaggaaauccagggagauuuuggaauacaacuauugcagugucaauggcuaacauuuuuagagggaguuaccuggccggagccggacuucucuuuucuaucaugaagaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuuuacuccgccagaaaagugugacacauugcugugugacauaggggagucgucaccaaaccccacgguugaggcaggacgaacacucagaguucuaaacuuaguggaaaauuggcugaacaacaacacccaauuuugcauaaagguucucaacccauauaugcccucaguuauagaaaaaauggaagcgcuacaaaggaaauacggaggagcuuugguggggaauccacucucacgaaauuccacacacgagauguacugggcauccaaugcuuccgggaauauagugucaucagugaacaugauuucaagaauguugauuaacagauucacaaugagacauaagaaggccacauacgagccagacguugaccucggaagcggaacccgccacaucggaauugaaagugagacaccaaauuuagacauaauugggaaaagaauagaaaaaauaaaacaagagcaugaaacaucauggcacugugaccaagaccacccauacaaaacgugggccuaccauggcagcuacgaagcaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaaggcaccuaggaugugcaccagagaagaauucacaagaaaggugagaagcaaugcagccuuaggugccauguucacugaugagaacaaguggaagucggcacgugaggcuguugaagauaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcuacacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaccugacagucacagaagaaauugcagugaaaaacuggcuaguaagaguggggcgugagagguuaucaagaauggccaucaguggagaugauuguguugugaaacccuuagaugacagguuugcaagcgcucuaacagcucuaaaugacaugggaaaggucaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagauuacaugccauccaugaaaagauucagaagagaagaggaagaagcaggaguccugugguag

SEQ ID NO: 7009 - RNA, 9876 nt, Artificial Sequence
  derived and/or modified CDS sequence (wt) from DENV-2__KC964093__SS-prME
acugcaggugugaucaucaugaugauuccaacagugguggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaagagaucaguggcacucguuccacaugugggaaugggacuggagacacgaacugaaacauggaugucaucagaaggagccuggaaacaugcucagagaaucgaaacuugggucuugagacauccaggcuuuaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacgacgauggcgaaaaauaaaccaacauuggauuuugaacugacaaaaacggaagccaaacaucccgccacuuuaaggaaguauuguauagaggcaaagcugaccaacacaacaacagcaucucgcugcccaacacaaggagaacccagccuaaaugaagaacaggacaaaagguuugucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaauguagucggaaaugacacaggaaaacacggcaaggaaauuaaaguaacaccacagaguuccauuacagaagcagaacugacaggcuauggcacugucacgauggaaugcucuccgagaacgggccucgacuuuaaugagaugguguugcugcaaauggaagacaaggcuuggcuggugcacaggcaaugguucuuagaccugccguuaccauggcugcccggagcagacacacaaggaucaaauuggauacagaaggagacauuggucacuuucaaaaauccccaugcgaagaaacaggauguuguuguuuuaggaucccaagaaggggcuaugcauacagcacucacaggggccacggaaauccagaugucaucaggaaacuuauuguucacaggacaucuuaagugcaggcugagaauggacaaacuacagcucaaaggaaugucauauucuauguguacaggaaaguuuaaagcugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauuguuacagaaaaagacagcccagucaacauagaagcagaaccuccauucggagacaguuacaucauuauaggaguagaaccgggacaacugaagcucagcugguuuaagaaaggaagcucuauuggccaaauguuugagacaacaaugagaggagcgaagagaauggccauuuuaggugacacagcuugggauuuuggaucccugggaggaguguucacaucuauaggaaaagcccuccaccaagucuuuggagcaaucuauggggcugccuuuagcgggguuucauggacuaugaaaauccucauaggagucgucaucacauggauaggaaugaauucacgcagcaccucacugucugugucacuaguauuagugggggucgugacauuguauuugggagucauggugcaggccgauagugguugcguugugaguuggaaaaacaaagaacugaaaugugguagugggauuuuuaucacagacaacgugcacacauggacagaacaauacaaauuccagccagaauccccuucaaagcuggcuucagcaauccagaaggcucaugaagagggcauuuguggaauccgcucaguaacaagauuggagaaucugauguggaaacaaauaacaccagaacugaaucacauucuaucagaaaaugagguaaaauugacuaucaugacaggagacauuaaaggaaucaugcaggcaggaaaacgaucccugcggccucaacccacugagcugaaguacucuuggaaagcauggggcaaggcgaaaaugcucuccacagagcuucauaaccacaccuuucucauugauggccccgaaacagcagaaugucccaacacaaacagagcuuggaacucacuagaaguugaagacuauggcuuuggaguauuuaccaccaacauauggcugaaacugaaagaaaggcaggauguauuuugugacucaaaacucaugucagcagccauaaaagacaacagggccguccacgccgauauggguuauuggauagaaagcgcacuuaaugacacauggaagauugagaaagccucuuuuauugaaguuaaaagcugccacuggccaaagucacacacucucuggaguaauggagugcuagaaagugagaugauaauuccaaagaauuuugcaggaccagugucacagcacaacuacagaccaggcuaucauacacaaacggcaggacccuggcaucuagguaagcuugagauggacuuugauuuuugugaaggaaccacagugguagugacugaggacuguggaaauagaggacccucuuuaagaacaacuacugcuucuggaaagcucauaacagaauggugcugccggucuugcacauuaccaccgcuaagguacagaggugaggauggaugcugguauggaauggaaaucaggccauugaaagagaaagaagagaaccuggucaacucuuuggucacagccggacauggacagauugacaacuucucacuaggagucuugggaauggcauuguuccuggaagaaaugcucaggacccgcguaggaacgaaacaugcaauauugcuaguugcaguuucuuucgugacauugaucacagggaacaugucuucucgagauuuggggagagugaugguuauggugggcgccacuaugacggaugacauaggcaugggcgugacuuaucuugcccuauuagcagccuucaaagucagaccaacuuuugcagcuggacuacucuugagaaagcugaccuccaaggaauuaaugaugaccaccauaggaaucguacuccucucucagagcagcauaccagagaccauacuugaacugacugacgcguuggcucuggggaugaugguucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucgcuggaagaucggcugauuuggaacuggagagagcugcugacguaagaugggaagaacaggcagagauaucaggaaguagcccaauucugucaauaacaauaucggaagaugguggcaugucgauaaaaaaugaagaagaagaacaaacacugacuauacucauuagaacaggacugcuggugauaucaggacucuuucccgugucaauaccaaucacggcagcugcaugguaccugugggaagugaaaaaacaacgagccggaguauugugggaugucccuucacccccaccugugggaaaggccgaacuggaagauggagccuauagaaucaagcagaaagggauucuaggauacucgcagaucggagccggaguuuacaaagaaggaacauuccacacaauguggcacgucacacguggugcuguccuaaugcauaaagggaagagaauugaaccaucaugggcggacgucaagaaagaccuaauaucguauggaggaggcuggaagcuagaaggagaauggaaggaaggagaagaaauccagguccuggcauuagagccuggaaagaauccaagagccguccaaacaaaacccggucuuuuuaaaacuaacacuggaaccauaggcgccguaucucuggacuuuucuccuggaacgucaggaucuccaaucgucgacaaaaaaggaaaaguugugggccuuuauggcaacggugucgucacaaggaguggaacauaugugagugccauagcccagacugaaaaaagcauugaagacaauccagagauugaagaugacaucuuucgaaagaaaagauugaccaucauggaccuccacccaggggcgggaaaaacgaagagauaccuuccagcaauagucagagaagccauaaaacgaggcuugaggacauuaauccuggcccccacuagaguuguggcggcugaaauggaagaagcucucagaggacuuccaauaagauaccaaacccccgccaucagagcugagcacacugggcgggagauuguggaucuaaugugucacgccacauuuaccaugaggcugcuauccccaauuagaguaccaaauuacaaccugaucaucauggaugaagcccauuucacagacccagcaagcauagcagcuagaggauacauuucaacucgaguugagaugggugaagcagcugggauuuuuaugacagcuacuccuccuggaagcagagacccauuuccucagagcaaugcaccaaucauggaugaagaaagggaaaucccugagcgcucguggaauucuggacaugaauggguuacggauuuuaaagggaagacuguuugguuuguuccaaguauaaaagcaggaaaugauauagcagcuugccugagaaagaauggaaagaaagugauacaacucagcaggaagaccuuugauucugaauaugucaagacuaggaccaaugauugggacuuuguggucacgacagacauuucagaaaugggcgcuaacuucaaggcugagaggguuauagaccccaggcgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuucuagauaacaucaacacgccugaaggaaucauucccaguauguucgaaccagagcgugaaaggguggaugccauugauggugaauaccgcuuaagaggagaagcgaggaaaacuuuuguggaccuaaugagaagaggagaccuaccagucuggcuagccuauagaguggcagcugaagguaucaacuacgcagacagaagauggugcuuugauggagucaagaacaaucagaucuuggaagaaaauguggaaguggaaauuuggacaaaagaaggagaaaggaagaaauuaaaacccagaugguuggaugcuaggaucuacucugacccacuggcgcucaaagaauucaaggaauucgcagcuggaagaaagucccucacccugaaucuaaucacagagauggguaggcucccaaccuucaugacucagaaagcaaggaacgcacuagacgacuuagcaguccugcauacggcugaggcaggcggaagggcguacaaucaugcucuuagugaacugccggagacccuggagacauugcuuuuacugacacucuuggccacagucacgggcggaaucuuccuauucuugaugagcggaaaaggcauagggaagaugacccugggaaugugcugcauaaucacggccaguguucuccuaugguaugcacaaauacagccacacuggauagcagcuucaauaauacuggaguuuuuucucauagucuugcucauuccagaaccagaaaagcagagaacaccccaagauaaccaauuaacuuauguugccauagccauccuuacagugguggccgcaaccauggcaaacgagauggguuuccuggaaaagacaaagaaagacuucggauugggaagcauugcaacccagcagccugagagcaacauccuggacuuagaucuacguccugcaucagcuuggacucuauaugcuguggcaacaacuuucaucacaccaaugcugagacacagcauugaaaauuccucagugaaugugucucuaacggccauugccaaccaagccacaguuuuaaugggucuugggaaaggauggccauugucaaaaauggacaucggaguuccccuucucgcuaucgggugcuauucacaaguuaaccccauaacucucacggcagcccuucucuuauugguagcacauuaugccaucauagggccaggacuccaagcgaaagcaacuagagaagcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuugugugaagcuuuaaccuuagcgacugggcccaucuccacacugugggaaggaaauccagggagauuuuggaauacaacuaucgcaguaucaauggcuaacauuuuuagagggagcuaccuggccggagucggacuucucuuuucuaucaugaagaauacggccaacacaagaaggggaacuggcaacacaggagagacgcuuggagaaaaauggaaaaaccgauugaaugcauuggggaagagugaauuccagaucuacaagaaaaguggaauccaggagguggauagaaccuuagcaaaagaaggcaucaaaagaggagaaacggaccaucacgcugugucgcgaggcucggcgaaacugagaugguucgucgagagaaaccuggucacaccagaagggaaaguaauggaccucgguugcggcagggggggcuggucauacuauugugggggacuaaagaauguaaaagaagucaaaggccuaacaaaaggaggaccaggacacgaagaacccauucccaugucaacauaugguuggaaccuggugcgucuucaaaguggaguugauguuuuuuuugcuccgccagaaaagugugacacacuacugugugacauaggggagucgucaccaaaccccacgguugaggcaggacgaacacucagaguucuaaaccuaguggaaaauuggcugaacaacaacacccaauuuugcaucaagguucucaacccauauaugcccucaguuauagaaaaaauggaagcgcugcaaaggaaauacggaggagcuuuggugaggaauccacucucacgaaauuccacacacgagauguacuggguauccaacgcuuccgggaacauagugucaucagugaacaugauuucaagaauguugauuaacagauucacaaugagacauaagaaggccacauacgagccagauguugaccucggaagcggaacccguaacaucggaauugaaagugagauaccaaauuuggacauaauugggaaaagaauagaaaaaauaaaacaagagcaugaaacaucauggcacuaugaccaagaccacccauacaaaacgugggccuaccauggcagcuacgaaacaaaacagacuggaucggcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagauaguggauuuugggaacugguugacaaggaaaggaaucuucaucuugaaggaaagugugagacauguguguacaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagaagugagcaagaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcaccugacagucacagaagaaauugcagugaaaaacugguuaacaagaguggggcgugagagguuaucaagaauggcuaucaguggagaugauuguguugugaaaccccuagaugauagguuugcaagcgcucuaacagcucuaaaugacaugggaaaaguuaggaaagacauacaacaaugggaaccuucaagaggauggaacgauuggacacaagugcccuuuuguucacaccauuuccaugaguuaaucaugaaggacgggcguguacucguaguuccaugcagaaaccaagaugaacugauugguagggcccgaaucucccagggagccggguggucuuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacaugccacacaugaguggaugacaacagaagauaugcugacagucuggaacaggguguggauucaagaaaacccauggauggaagacaaaacuccaguagaaucaugggaggaaaucccauauuuggggaaaagagaagaccaauggugcggcucauugaucgggcuaacaagcagggccacuugggcaaagaacauccaaacagcaauaaaucaaguuagguccuuaauaggcaaugaggaauacacagacuacaugccauccaugaaaagguucagaagagaagagggagaggcaggagucuugugguag

SEQ ID NO: 7010 - RNA, 9876 nt, Artificial Sequence
  derived and/or modified CDS sequence (wt) from DENV-2__DQ448231__SS-prME
acugcaggcgugaucaucaugcugauuccaacagcgauggcguuccauuuaaccacacgcaacggagaaccacacaugaucgucagcagacaagagaaagggaaaagucucuuguuuaaaacagaggauggugugaacauguguacccucauggccauggaccuuggugaacugugugaagacacaaucacuuauaacuguccucuucucaggcagaaugaaccagaagacauagauuguugguguaacuccacguccacauggguaacuuaugggacaugcacugccacaggagaacacagaagggaaaaaagaucaguggcacucgucccacaugugggaaugggauuggagacacgaacugaaacauggaugucaucagaaggggccuggaaacacgcccagagaauugaaaccuggaucuugagacauccagguuuuaccauaauggcagcaaucuuggcauacaccauaggaacgacauauuuccaaagaguccugaucuucaucuuacugacagcugucgcuccuucaaugacaaugcguuguauuggaauaucaaauagagacuuuguggaagggguuucaggaggaagcuggguugacauagucuuagaacauggaagcugugugacaacgauggcaaaaaacaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguuugucugcaaacauuccaugguagacagaggauggggaaauggauguggauuauuuggaaagggaggcaucguaaccugugcuauguucacaugcaaaaaaaacauggaaggaaaaauugugcagccagaaaaccuggaauacaccauugugguaacaccucauucaggggaagagaacacaguuggaaaugacacaggaaaacauggcaaggaaaucaaaguaacaccacagaguuccauuacagaagcagaacugacaggcuacggcacugucacgauggagugcucuccaagaacgggccucgacuucaaugagaugguguugcugcaaauggaaaauaaggcuuggcuggugcacaggcaaugguucuuagaccugccguuaccaugguugcccggagcggacacacaaggaucaaauuggauacagaaggagacguuggucaccuucaaaaauccccaugcgaagaaacaggauguuguuguuuuaggaucccaagaaggggcuaugcauacagcacuuacaggggccacggaaauccagaugucgucaggaaaccuacuguucacaggacaucucaagugcaggcugagaauggacaaauuacagcuuaaaggaaugucauacucuauguguacaggaaaguuuaaaguuguaaaggaaauagcagaaacacaacauggaacaauaguugucagaguacaauaugaaggggauggcucuccauguaaaaucccuuuugagauaauggauuuggaaaaaagacaugucuuaggucgccugauuacagucaacccaaucgucacagaaaaagacaguccagucaacauagaagcagaaccuccauucggagacagcuacaucauuauaggaguagaaccgggacaacugaagcucagcugguuuaagaaaggaagcucaaucggccaaauguucgagacaacaaugagaggagcgaagagaauggccauuuuaggugacacagccugggauuuuggaucccugggaggaguguucacaucuauaggaaaggcccuccaccaagucuuuggagcaaucuauggggcugccuucaguggggucucauggacuaugaaaauccucauaggaguugucaucacauggauaggaaugaauucacguagcaccucacugucugugucacuaguauuagugggagucgugacauuguauuugggaguuauggugcaggcugauagugguuguguugugaguuggaaaaacaaagaacugaaauguggcagugggauuuuuaucacagacaauguacacacauggacagaacaauacaaauuccaaccagaaucccccucaaagcuggcuucagcuauccagaaagcucaugaagagggcauuuguggaauccgcucaguaacaagacuggagaaucuaauguggaaacaaauaacaccagaacugaaucacauucuaucagaaaaugagguaaaguugacuaucaugacaggagacaucaaaggaaucaugcaggcaggaaaacgaucccugcggccucagcccacugagcugaaguauucauggaaaacguggggcaaagcgaaaauacucuccacagagccucauaaccagaccuuucucauugauggccccgaaacagcagaaugucccaacacaaacagagcuuggaacucacuagaaguugaagacuauggcuuugggguauucaccaccaacauauggcugaaguugaaagaaaggcaggauguguuuugugauucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacacacucucuggaguaauggagugcuagaaagugagaugauaauuccaaagaauuuugcuggaccaguaucacaacauaauuauagaccaggcuaucacacacaaacggcaggacccuggcaucuaggcaagcuugagauggacuuugauuuuugcgaaggaaccacagugguggugacugaggacuguggaaauagaggacccucucuaagaacaacuaccgcuucuggaaaacucauaacagaauggugcugccgauccugcacauuaccaccacuaagauacagaggugaggauggaugcugguacggaauggaaaucagaccauugaaagagaaagaagagaacuuggucaauucuuuggucacagccggacauggacagauugacaacuucucacuaggagucuugggaauggcacuguuccuggaagaaaugcucaggacccgaguaggaacaaaacaugcaguauuacuaguugcaguuucuuucaugacauugaucacagggaacaugucuuuccgagaccuggggagagugaugguuauggugggggcugcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccauaccagagacuauacuugaacugacugaugcguuggccuugggcaugaugauucucaagauagugagaaauauggaaaaguaucaauuagcagugacuaucauggcuaucuuauguguuccaaaugcagugauauuacaaaaugcauggaaagugagcugcacaauacuggcagugguguccguauccccacugcucuuaacaucuucacagcagaaagcggauuggauaccauuggcauugacgaucaaaggucucaauccaacagccauuuuccuaacaacccuuucaagaacuaacaagaaaaggaguuggccacuaaaugaggcuaucauggcagucgggauggugagcauuuuagccaguucucucuugaagaaugacauucccaugacaggaccauuaguggcuggagggcuucucacuguguguuacgugcucacuggaagaucggccgacuuggaacuggagagagccgccgacguaagaugggaagaucaggcagagauaucaggaagcaguccaauucugucaauaacaauaucggaagauggcagcaugucgauaaaaaaugaagaggaagaacaaacacugaccauacucauuagaacaggauugcuggugauaucaggacuuuuucccguaucaauaccaaucacggcagcagcaugguaccugugggaagugaagaaacaacgggcuggaguauugugggauguuccuucacccccaccugugggaaaggccgaacuggaagauggagcuuauagaaucaagcagaaagggauucuuggauacucccagaucggagcuggaguuuacaaagaaggaacauuccacacaauguggcacgucacacguggugcuguucuaaugcauaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuuuaaaacuaacaccggaaccauaggcgcugugucucuagacuuuucuccuggaacgucaggaucuccaaucgucgacaaaaaaggaaaagucgugggucucuauggcaauggugucgucacaaggaguggaacauaugugagugccauagcccagacugaaaaaagcauugaagacaauccagagauugaagaugauaucuuucgaaaaaaaagauugaccauuauggaccuccacccaggagcgggaaagacgaaaagauaccuuccagcaauagucagagaggccauaaaacgaggcuuaagaacauuaauccuggcccccacuagagucguggcagcugaaauggaagaagcucuuagaggacuuccaauaagauaccaaaccccagccauuagagcugagcacacugggcgagaaaucguggauuugaugugucaugccacauuuaccaugaggcuguuaucaccaguuagaguaccaaauuacaacuugaucauuauggaugaagcccauuucacagacccagcaagcauagcagcuaggggauacauuucaacucgaguagagaugggugaagcagcugggauuuucaugacagccacuccuccgggaagcagagacccauuuccucaaagcaaugcaccaaucauggaugaagaaagggaaaucccugaacguucguggaacucuggacaugaguggguuacagauuuuaaagggaagacuguuugguuuguuccgaguauaaaagcaggaaaugauauagcagcuugccugagaaaaaauggaaagaaagugauacaacucaguaggaagaccuuugauucugaauacaucaagacuaggaccaaugauugggacuuuguggucacgacugacauuucagaaaugggugcuaacuucaaggcugaaaggguuauagaccccaggcgcugcaugaaaccagucauacuaacagacggugaagagcgggugauccuggcaggacccaugccagugacccacucuagugcagcacaaagaagagggagaauaggaagaaauccaaagaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugccauugacggugaauaccgcuuaagaggagaagcgaggaaaaccuuuguggaccuaaugagaagaggagaccuaccagucuggcuggccuacagaguggcagccgaaggcauuaacuaugcagacagaaggugguguuuugauggaaucaagaacaaccaaaucuuggaagagaauguggaaguggaaaucuggacaaaagagggggaaaggaagaaacugaaacccagaugguuggaugcuaggaucuacucugacccacuggcgcucaaagaauucaaagaguuugcagcuggaagaaaaucccugacccugaauuuaaucacagaaaugggcaggcuuccaacuuuuaugacucagaaagcaaggaacgcacuggacaacuuagcaguccugcauacggcugaagcaggcggaagggcguacaaucaugcccucagugaacugccagagacccuggagacauugcuuuugcugacacuuuuggccacagucacgggcggaaucuuuuuauucuugaugaguggaaaagguauagggaaaaugacccugggaaugugcugcauaaucacggccaguauucuccuaugguacgcacaaauacaaccacacuggauagcagcuucaauaauacuggaguuuuuucucauagucuugcucauuccagagccagaaaagcaaagaacaccccaagauaaccaauugacuuacguugucauagccauccucacagugguggccgcaaccauggcaaacgagaugggguuccuggaaaaaacgaagaaagauuucggauugggaagcauugcaacccagcaacccgagagcaacauccuggacauagaucuacguccugcaucagcauggacccuguaugcaguggccacaacauuuaucacaccaauguugagacauagcauugaaaauuccucagugaaugugucuuuaacagccauugccaaucaagccacagugcuaaugggucuugggaagggauggccauugucaaaaauggacauuggaguuccccuucucgccaucgggugcuauucacaagucaaucccauaacccucacagcagcccuucuuuuauugguagcacauuaugcuaucauagggccagggcuccaagcgaaagcaaccagagaagcgcagaaaagagcagcagcaggcauuaugaaaaacccaacuguggauggaauaacagugauugaccuagauccaauacccuaugauccaaaauuugagaagcagcugggacaaguaaugcuccuaguccucugcgugacucaaguacugaugaugaggacuacaugggcuuugugugaggcucuaacuuuagcgaccgggcccaucuccacauugugggaaggaaauccagggagauuuuggaauacaaccauugcagugucaauggcuaacauuuuuagaggaaguuaccuagcuggagcuggacuucucuuuuccaucaugaagaacacaaccaacacaagaaggggaacuggcaacacaggagagacgcuuggagagaaauggaaaaaccgauugaauucauuggggaagagugaauuccagaucuacaagagaagcggaauccaggaaguggauagaaccuuggcaaaagaaggcauuaaaagaggagaaacggaccaucacgcugugucgcgaggcucagcaaagcugagaugguucgucgagagaaaccuggucacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugauguuuucuuuacuccgccagaaaagugugacacauuguugugugacauaggggagucgucaccaaaucccacgguugaagcaggacgaacacucagaguccuaaacuugguagaaaauuggcugaacaacaacacccaauuuugcauaaagguucuuaacccauacaugcccucagucauagaaaaaauggaaacgcugcaaaggaaauacggaggagcuuuggugaggaauccacucucaagaaauuccacacaugagauguauuggguauccaaugcuuccgggaacauagugucaucagugaacaugauuucaaggauguugaucaauagauuuacaaugagacauaagaaggccacauacgagccagauguugaccucggaagcggaacccgcaacaucggaauugaaagugagacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccauggugaauggaguaguuagacuguugacaaaaccuugggacgucaucccuauggugacacagauggcaaugacagacacgaccccauuuggacaacagcgcguuuucaaagagaaaguggacacgagaacccaagaaccgaaagaaggcacgaagaaacuaaugaaaaucacggccgaauggcucuggaaagaacuaggaaagaaaaagacaccuagaaugugcacuagagaagaauucacaagaaaggugagaagcaaugcagcccuaggugccauauucacugaugagaacaaguggaagucggcacgugaggcuguugaagacaguagauuuugggaacugguugauaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuccugaaugaagaucacugguuuuccagagagaacucucugagcggaguggaaggagaagggcugcauaagcuggguuacauucuaagagaagugagcaagaaagaaggaggagcaauguacgccgacgacacagcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagacccacaccaagaggcacaguaauggauauuauaucgagaagagaccagagagguaguggacaaguuggcaccuauggccucaacaccuuuaccaauaugggagcacaacuaaucagacagauggagggagaaggagucuuuaaaggcauccaacaucugacagccacagaagaaguagcagugcaagacugguuagcaagaguggggcgugagagguuaucaagaauggccaucaguggagaugacuguguugugaaacccuuagaugacagguuugcaagcgcuuuaacagcucuaaaugacaugggaaagauuaggaaagacauacaacaaugggaaccuucaagaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcggcaaacgcuauuugcucggcagucccaucacauuggguuccaacaagucgaacaaccugguccauacacgccagacaugaauggaugacaacagaagacaugcugacagucuggaacaggguguggauucaagaaaacccauggauggaagacaaaacuccaguggaaucaugggaggaaaucccauacuuggggaaaagagaagaccaauggugcggcucauugauaggguuaacaagcagggccaccugggcaaagaacauccaaacagcaauaaaccaaguuagauccuuaauaggcagugaggaauacacagacuauaugccauccaugaaaagauucagaagagaagaggaagaggcaggggucuugugguag

SEQ ID NO: 7011 - RNA, 9876 nt, Artificial Sequence
  derived and/or modified CDS sequence (wt) from DENV-2__JX470186__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagauugcuggugcaacucuacgucuacauggguaacuuacgggacaugcaccgccacaggagaacacagaagggaaaaaagaucaguggcacucguuccacaugugggaaugggacuggagacacgaacugaaacauggaugucaucagaaggggccuggaaacaugcccagagaauugaaacgugggucuugagacauccaggcuucaccauaauggcagcaauccuggcuuacaccauaggaacgacauacuuccaaagaguccugaucuucaucuuacugacagcugucgcuccuucaaugacaaugcguuguauaggaauaucaaauagagacuuuguggaagggguaucaggaggaagcuggguugacauagucuuggaacauggaagcugugugacgacgauggcgaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggagguaucgugaccugugcaauguucacaugcaaaaagaacauggaaggaaaaaucgugcaaccagaaaacuuggaguacaccaucgugauaacaccucacucaggggaagagaaugcagucggaaaugacacaggaaaacacggcaaggaaauuaaaguaacaccacagaguuccaucacagaagcagaacuaacaggcuauggcacuguuacgauggaaugcucuccgagaacgggccucgacuucaaugagaugguguugcugcaaauggaaaacaaggcuuggcuggcgcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggccaugcacacagcacucacaggggccacggaaauccagaugucaucaggaaacuugcuguucacaggacaucuuaaguguaggcugagaauggacaaauuacaacucaaaggaaugucauauuccauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaaucgucacagagaaagacagcccagucaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuuaggagggguguucacauccauaggaaaggcccuccaccaagucuuuggagcaauuuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuagagaaucugauguggaaacaaauaacaccagaacugaaucacauuuuaucagaaaaugagguaaaguugacuaucaugacaggagacauuaaaggaaucaugcaggcaggaaaacgaucccuacggccucaacccacugaguugaaguacucuuggaaagcauggggcaaagcgaaaaugcucuccacagagcuucauaaccacaccuuucucauugauggccccgaaacagcagaaugucccaacacaaacagagcuuggaacucacuagaaguugaagacuauggcuuuggaguauuuaccaccaacauauggcugaaaaugaaagaaaggcaggauguauuuugugacucaaaacucaugucagcagccauaaaagacagcagagccguccacgccgauauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugagauggacuucgauuucugcgaaggaaccacagugguggugacugaggacuguggaaauagaggacccucuuuaagaacaacuacugcuucuggaaaacucauaacagagugguguugccgaucuugcacacuaccaccgcuaagguacagaggugaggauggaugcugguauggaauggaaauuagaccauugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuauuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaaucgugcuccucucccaggccaccauaccagagacuauacuugaacugacugacgcguuggcuuuggggaugaugguucucaaaauagugagaaacauggaaaaguaucaacuagcagugacuaucauggccaucuugugcgucccaaaugcagugauauuacaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuaacaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuggugguaucaggacucuuucccgugucaacaccaaucacggcagcugcaugguaccugugggaagugaaaaaacaacgagcaggaguauugugggaugucccuucacccccaccugugggaaaggccgaacuggaggauggagccuacagaaucaagcagaaagggauucuaggauacucgcagaucggagcuggaguuuacaaagaaggaacauuucacacaauguggcaugucacacguggugcuguucuaaugcauaaagggaagagaauugaaccaucaugggcggacgucaagaaagaucuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggugccgugucucuggacuuuucuccuggaacgucaggaucuccaaucgucgacaaaaaaggaaaaguugugggccuuuauggcaacggugucguuacaaggaguggaacauaugugagugcuauagcccagacugaaaaaagcaucgaagacaauccagagauugaagaugacaucuuucgaaagaaaagauugaccaucauggaccuccauccaggagcaggaaaaacaaagagauaccuuccagcaauagucagagaagccauaaaacgaggcuugagaacacuaauccuggcccccacuagagugguggcggcugaaauggaagaagcucucagaggacuuccaauaagauaccaaaccccagcuaucagagcugagcacacugggcgggagauuguggaucuaaugugucacgccacauuuaccaugaggcugcuaucaccaauuagagugccaaauuacaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaaugcaccaaucauggaugaagaaagggaaaucccugagcguucguggaacucuggacaugaguggguuacggauuuuaaagggaagacuguuugguuuguuccaaguauaaaagcagggaaugacauagcagcuugccugagaaagaauggaaagaaagugauacaacucagcaggaagacuuuugacucugaauauaucaagacuaggaccaaugauugggacuuuguggucacgacagacauuucagagaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagccaaaaugcuucuagacaacaucaacacgccugaaggaaucauucccagcauguucgaaccagagcgcgaaaagguggaugccauugauggugaauaccgcuugagaggagaagcgaggaaaacuuucguggaccuaaugagaagaggagaccuaccagucugguuagccuacagaguggcagcugaagguaucaauuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaguucgcagcuggaagaaagucccugacccugaaucuaaucacagagauggguaggcucccaaccuucaugacccagaaagcaaggaaugcacuggauaacuuagcagucuugcauacagcugaagcaggcggaagggcguacaaucaugcucuuagugaacugccggagacucuggagacauugcuuuuacugacacucuuggccacagucacgggcggaaucuuccuguucuugaugagcggaaaagguauagggaagaugaccuugggaaugugcugcauaauuacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaagcauuacaacccagcaaccugagaacaacauccuggacauagaucuacguccugcaucagcuuggacucuauaugccguggcaacaacuuucaucacaccaauguugagacauagcauugaaaauuccucagugaaugugucucuaacagcuauugccaaccaagccacgguguuaaugggucuugggaaaggauggccauuaucaaaaauggacaucggaguuccccuucucgcuaucgggugcuauucacaagucaaccccauaacucucacagcagcccuucuccuauugguagcacauuaugcuaucauagggccaggacuccaagcgaaagcaacuagagaagcucagaaaagagcagcagcgggcaucaugaaaaacccaacuguggauggaauaacagugauugaccuagauccaauacccuaugacccaaaguuugaaaagcaguugggacaaguaaugcucuuaguccucugcgugacucaaguauugaugaugaggaccacaugggcuuuaugugaagcucuaaccuuagcaaccgggcccaucucuacacugugggaaggaaauccaggaagauucuggaauacaacuauugcagugucaauggcuaacauuuuuagagggaguuaccuggccggagccggacuucucuuuucuaucaugaagaacacggccaacacaagaaggggaacuggcaacacgggagagacgcuuggagagaaauggaaaaaccgguugaaugcauugggaaagagugaauuccagaucuauaagaaaaguggaauccaggaaguggauagaaccuuagcaaaagaaggcaucaaaagaggagaaacggaccaucaugcugugucgcgaggcucggcgaaacugagaugguucgucgagagaaaccuggucacaccagaagggaaaguaguggaccuugguuguggcaggggaggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuuuacuccgccagaaaagugugacacauugcugugugacauaggggagucgucaccaaaccccacuguugaagcaggacgaacacucagaguucuaaaccuaguggaaaauuggcugaacaauaacacccaauuuugcauaaagguucucaacccauauaugcccucaguuauagaaaaaauggaagcgcugcaaaggaaauacggaggagcuuuggugaggaauccacucucacgaaauuccacacacgagauguacuggguauccaaugcuuccgggaacauagugucaucagugaauaugauuucaagaauguugaucaacagauucacaaugagacacaagaaggccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacguuaucccuauggugacacagauggcaaugacagacacgacuccauuuggacaacagcgcguuuucaaagagaaaguggacacgagaacccaagaaccgaaagaaggcacgaaaaaacuaaugaagaucacggcagaauggcucuggaaagaacuaggaaagaaaaagacaccuaggaugugcaccagagaagaauucacaagaaaggugagaaguaaugcagccuuaggcgccauauucacugaugagaacaaguggaagucggcacgugaggcuguugaagacagcggauuuugggaauugguugacaaggaaaggaaucuccaucuugaaggaaagugugagacauguguauauaacaugaugggaaagagagagaagaagcuaggggaguucggcaaagcgaaaggcagcagagccauaugguacauguggcuuggagcacgcuucuuagaguuugaagcccuaggauuuuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaagaaacuugcugaagccaucuucaaacuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaacugacaguuacagaagaaauugcagugaaaaacugguuaguaagaguggggcgugagagguuaucaagaauggccauuaguggagaugacuguguugugaaacccuuagaugacagguuugcaagcgcucuaacagcucuaaaugacaugggaaagguuaggaaagacauacaacaaugggaaccuucaagaggauggaacgacuggacacaagugccuuuuuguucacaccauuuccaugaguuaaucaugaaggacggucguguacucguaguuccaugcagaaaucaagaugaacugauugguagggcccgaauuucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacgcaugaguggaugacaacagaagacaugcugacagucuggaacaggguguggauccaagaaaacccauggauggaagacaaaacuccaguggagucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaagaggaagaggcaggagucuugugguag

SEQ ID NO: 7012 - RNA, 9876 nt, Artificial Sequence
  derived and/or modified CDS sequence (wt) from DENV-2__KU517846__SS-prME
acugcagguauaauuauuaugaugauuccaacagugauggcguuccauuuaaccacacgcaauggagaaccacacaugaucgucaguagacaagaaaaagggaaaagucuucuguuuaaaacagagaacggugugaacauguguacccucauggccauggaccuuggugaacugugugaagacacaaucacuuauaauugcccucuucucaggcagaaugaaccagaagacauagacuguuggugcaacucuacgucuacauggguaacuuaugggacaugcaccgccacaggagaacacagaagggaaaaaagaucaguggcacucguuccgcaugugggaaugggacuggagacacgaacugaaacauggaugucaucagaaggggccuggaaacaugcgcagagaauugaaacuugggucuugagacacccaggcuucaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuggaacauggaagcugugugacaacgauggcgaaaaauaaaccaacacuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagauagaggauggggaaauggaugcggauuauuuggaaagggagguaucgugaccugugcaauguucacauguaaaaagaacauggaaggaaaaaucgugcaaccagaaaauuuggaguacaccaucgugauaacaccucacucaggggaagagaaugcagucggaaaugacacaggaaaacacggcaaggaaauuaaagugacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaagagacauuggucacuuucaaaaauccccaugcaaagaaacaggauguuguuguuuuaggaucccaagaaggggcuaugcacacagcacucacaggggccacggagauccagaugucaucaggaaacuuacuguucacaggacaucuuaaaugcagguugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaaaaucccuuuugaaauaauggauuuggaaaaaagacaugucuuaggucgcuugaucacagucaacccgauugucacagaaaaagacagcccagucaauauagaagcagaaccuccauucggagauagcuacaucauuauaggaguagaaccgggacaacugaagcucagcugguucaagaaaggaaguucuauuggccaaauguuugagacaacaaugcgaggagcaaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauucucauaggaguugucaucacauggauaggaaugaauucacgcagcaccucacugucugugucacuaguauuagugggaaucgugacauuguauuugggaguuauggugcaggcugauagugguuguguugugaguuggaaaaacaaagaacugaaauguggcagcgggaucuucaucacagacaacgugcacacauggacagaacaauacaaauuccaaccagaauccccuucaaaacuggccucagcuauccagaaggcccaugaagagggcauuugugggauccgcucaguaacaagacuggagaaccugauguggaaacaaauaacaccagaacugaaucacauucuaucagaaaaugagguaaaguugacuaucaugacaggagacauuaaaggaauuaugcaggcaggaaaacgaucccugcggccucaacccacugagcugaaguacucuuggaaagcauggggcaaagcgaaaaugcucuccacagagcuucacaaccacaccuuucucauugauggccccgaaacagcagaaugucccaacacaaacagagcuuggaauucacuagaaguugaagacuauggcuuuggaguauucacuaccaacauauggcugaaauugaaagaaaggcaggauguauuuugugacucaaaacucaugucagcagccauaaaagacaacagagccguccacgccgauauggguuauuggauagaaagugcacucaacgacacauggaagauugagaaagccucuuuuauugaaguuaaaagcugccacuggccaaagucacacacucucuggagcaauggagugcuagaaagugagaugauaauuccaaagaauuuugcaggaccagugucacaacacaauuauagaccaggcuaucauacacaaacggcaggacccuggcaccuaggcaggcuugagauggacuuugacuucugcgaaggaaccacagugguggugacugaggacuguggaaauagaggacccucuuuaagaacaacuacugcuucuggaaaacucauaacagaauggugcugccgaucuugcacauuaccaccacuaagguauagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuauuaguugcagucucuuucaugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaauuguacuccucucucagagcaccauaccagagacaauacuugaacugacugaugcguuggcuuuggggaugaugguucucaaaauaguaagaaacauggaaaaguaucaacuagcagugacuaucauggcuauccugugcgucccaaacgcagugauauuacaaaacgcauggaaagugagcugcacgauacuggcagugguauccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucagcugauuuggaacuggaaagagcugcugacguaagaugggaggaacaggcagagauaucagggagcaguccaauucugucgauaacaauaucggaagauggcaguaugucgauaaaaaaugaagaagaagaacuaacacugaccauacuuauuagaacaggacugcuggugauaucaggacuuuuucccgugucaauaccaaucacggcagcugcaugguaccugugggaagugaaaaaacaacgagccggaguauugugggaugucccuucaccuccacccgugggaaaggccgaacuggaagacggagccuauagaaucaagcagaaagggauuuuaggauacucgcagaucggagccggaguuuacaaagaaggaacauuccacacaauguggcaugucacacguggugcuguucuaaugcacaaagggaagaggauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaaccuggucuuuuuaaaacuaacacuggaaccauaggcgccguaucucuggacuuuucuccuggaacgucaggaucuccaauugucgacaaaaaaggaaaaguugugggccuuuauggcaacggugucgucacaaggaguggaacauaugugagcgccauagcccagacugaaaaaagcaucgaagacaauccagagauugaagaugacaucuuucgaaagaaaagauugaccaucauggaucuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauucaccaugaggcuacuaucaccaaucagagugccaaauuacaaccugauuaucauggaugaagcccauuuuacagacccagcaagcauagcagcuagaggauacauuucaacucgaguagagaugggugaagcagcugggauuuucaugacagcuaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcgcacuggaaagaagccaagaugcuucuagauaacaucaacacgccugaaggaaucauucccagcauguucgaaccagagcgugagaagguggaugccauugauggugaauaccgccugagaggagaagcgaggaaaacauuuguggaccuaaugagaagaggagaccuaccagucuggcuagccuacagaguggcagcugaagguaucaacuacgcagacagaagauggugcuuugauggagucaagaacaaccaaauccuggaagaaaauguggaaguggaaauuuggacaaaagaaggagaaaggaagaaauuaaaacccagaugguuagaugccaggaucuacucugacccacuggcgcucaaagaauucaaggaauucgcagcuggaagaaaaucccugaccuugaaucuaaucaccgagauggguaggcucccaaccuucaugacccagaaagcaaggaaugcauuggacaacuuagcaguccugcauacggcugaagcaggcggaagggcguacaaucaugcucuuagugaacugccggagacucuggagacauugcuuuuacugacacuuuuggccacagucacggguggaaucuuccuguucuugaugagcggaaagggaauagggaagaugacccugggaaugugcugcauaaucacggccaguauucuccuaugguaugcacaaauacagccacacuggauagcagcuucaauaauacuggaguuuuuucuuauagucuugcucauuccagaaccagagaagcagagaacaccccaagauaaccaauuaacuuauguugucauagccauccuuacagugguggccgcaaccauggcaaacgagauggguuuccuggaaaagacaaagaaagauuucggauuaggaagcauuacaacccagcaaccugagagcaacauccuggacauagaucuacguccugcaucagcuuggacucuauaugccguggcaacaacuuucaucacaccaauguugagacacagcauugaaaauuccucagugaauguaucucuaacagccauugccaaccaggccacaguguuaaugggucuugggaaaggauggccauugucaaaaauggacaucggaguuccccuucucgcuaucggaugcuauucacaagucaaccccauaacucucacagcggcccuucucuuauugguagcacacuaugcuaucauagggccaggacuccaagcgaaagcaacuagagaggcucagaaaagagcagcagcgggcaucaugaaaaacccaacuguggauggaauaacagugauugaccuagauccaauaccuuaugauccaaaguuugaaaagcaguugggacaaguaaugcucuuaguccucugcgugacucaaguauugaugaugaggacuacaugggcuuuaugugaagcucuaaccuuagcgaccgggcccaucucuacacugugggaaggaaauccagggagguuuuggaauacaacuauugcagugucaauggcuaacauuuuuagagggaguuaccuggccggagccggacuucucuuuucuaucaugaagaacacggccaacacaagaaggggaacuggcaacacaggagagacgcuuggagagaaguggaaaaaccgguugaaugcauuggggaagagugaauuccagaucuauaagaaaaguggaauccaggaaguagauagaaccuuagcaaaagaaggcaucaaaaggggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaagggggaccaggacaugaagagcccauucccaugucaacauaugguuggaaucuggugcgucuucaaaguggaguugaugucuuuuuuacuccgccagaaaagugugacacauugcugugugacauaggggagucgucaccaaaccccacgguugaggcaggacgaacacucagaguucuaaaccuaguggaaaacuggcugaacaacaacacccaauuuugcauaaagguucucagcccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaagccacauacgagccagauguugaucucggaaguggaacccgcaacaucggaauugaaagugagacaccaaauuuagacauaauugggaaaagaauagaaaaaauaaaacaagagcaugagacaucauggcacuaugaccaggaccacccauacaaaacgugggccuaccauggcagcuaugaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagaaaaaguggacacgagaacccaagaaccgaaagaagguacgaaaaaacuaaugaaaaucacggcagaauggcucuggaaagaacuaggaaagaaaaagacaccuaggaugugcaccagagaagaauucacaagaaaggugagaagcaaugcagccuuaggagccauauucacugaugagaacaaguggaagucggcacgugaggcuguugaagacaguggauuuugggaauugguugacaaggaaaggaaucuccaucuugaaggaaagugugagacauguguguacaacaugaugggaaagagagagaagaaacuaggggaguucggcaaagcaaaaggcagcagagcaauaugguacauguggcuuggagcacgcuucuuagaguuugaagcccuaggauuuuugaaugaagaccacugguuuuccagagagaacucccugaguggaguggaaggagaagggcugcacaaacuaggcuacauuuuaagagacgugaguaagaaagagggaggagcaauguacgccgaugacaccgcaggaugggacacaagaaucacacuagaggacuuaaaaaaugaagagauggugacaaaccacauggaaggagaacacaagaaacuugcugaagccauuuucagauuaacguaccaaaacaagguggugcgugugcaaagaccgacaccaagaggcacaguaauggacaucauaucgagaagagaccaaagagguaguggacaaguugucacuuacggccucaacacuuucaccaacauggaagcccaacugaucagacagauggagggagaaggagucuucaaaaguauccaacaccugacagucacagaagagauugcagugaaaaacugguuagaaagaguggggcgugagagguuaucaagaauggccaucaguggagaugauuguguugugaaacccuuagaugacagguuugcaagcgcucuaacagcucuaaaugacaugggaaaaauuaggaaagacauacaacaaugggaaccuucaagaggauggaacgauuggacacaagugcccuuuuguucacaccauuuccaugaguuaaucaugaaagacggucguguacuuguaguuccauguagaaaccaagaugaacugauugguagggcccgaauuucccagggagccgggugguccuugcgggaaacagcuuguuuggggaagucuuacgcccaaauguggagccugauguacuuccacagacgugaccuuaggcuggcggcaaaugccauuugcucggcaguuccaucacauuggguuccaacaagucgaacaaccugguccauacacgccacacaugaguggaugacaacagaagacaugcugacagucuggaacaggguguggauucaagaaaauccauggauggaagacaaaacuccaguagaaucaugggaggaaaucccauaucuggggaaaagagaagaccaauggugcggcucauugauugggcuaacaagcagggccaccugggcaaagaacauucaaacagcaauaaaucaaguuagaucccuaauaggcaaugaggaauacacagacuacaugccauccaugaaaagauucagaagagaagaggaagaggcaggagucuugugguaa

SEQ ID NO: 7013 - RNA, 9876 nt, Artificial Sequence
  derived and/or modified CDS sequence (wt) from DENV-2__KJ830750__SS-prME
accgcaggcgugaucaucaugcuaauuccaacagcgauggcguuucauuuaaccacacgcaacggagaaccacacaugaucgucagcaaacaagagaaagggaaaagucucuuguuuaaaacagaggauggugugaacaugugcacccucauggccauggaccuuggugaacugugugaagacacaaucacuuauaacuguccucuucucaggcagaaugaaccagaagauauagauuguugguguaacuccacguccacauggguaacuuaugggacaugcacugccacaggagaacacagaagggaaaaaagaucaguggcacucgucccacaugugggaaugggauuggagacacgaacugaaacguggaugucaucagaaggggccuggaaacacgcccagagaauugaaaccuggaucuugagacauccagguuuuaccauaauggcagcaaucuuggcauacaccauaggaacgacauauuuccaaagaguccugaucuucaucuuacugacagcugucgcuccuucaaugacaaugcguuguauuggaauaucaaauagagacuuuguggaaggggucucagggggaaguuggguugacauagucuuagaacauggaagcugugugacaacgauggcaaaaaacaagccaacauuggacuuugaacugauaaaaacagaagcuaagcaaccugccacucuaaggaaguacuguauagaagcaaagcugaccaacacaacaacagcaucucgaugcccaacacaaggggaacccagccuaaaugaagaacaggacaaaagguuugucugcaaacauuccaugguagacagaggauggggaaauggauguggauuauuuggaaagggaggcaucgugaccugugcuauguucacaugcaaaaaaaacauggaagggaaaauugugcaaccagaaaaccuggaauacaccauugugguaacaccucauucaggggaagagaaugcaguuggaaaugacacaggaaaacauggcaaggaaaucaaagugacaccacagaguuccauuacagaagcagaacugacaggcuacggcacugucacgauggagugcucuccaagaacgggccucgacuucaaugagaugguguugcugcaaauggaaaacaaggcuuggcuggugcacagacaaugguucuuagaccugccguuaccaugguugcccggagcggacauacaaggaucaaauuggauacagaaggagacgcuggucacuuucaaaaauccccaugcgaagaaacaggauguuguuguuuuaggaucccaagaaggggcuaugcauacagcacuuacaggggccacggaaauccagaugucaucaggaaaccuacuguucacaggacaucucaagugcaggcugagaauggauaaauuacagcucaaaggaaugucauacucuauguguacaggaaaguuuaaaguuguaaaggaaauagcagaaacacaacauggaacaauaguugucaggguacaauaugaaggggauggcucuccauguaaaaucccuuuugagauaauggauuuggaaaaaagacaugucuuaggucgccugauuacagucaacccaaucgucacaggaaaagacaguccagucaacauagaagcagaacccccauucggagacagcuacaucauuauaggaguggaaccgggacaacugaagcucagcugguuuaagaaaggaagcucaaucggccaaauguucgagacaacaaugagaggagcgaagagaauggccauuuuaggugacacagccugggauuuuggaucccugggaggaguguucacaucuauaggaaaggcccuccaccaaguuuuuggagcaauuuauggggcugccuucagugggguuucauggacuaugaaaauccucauaggaguugucaucacauggauaggaaugaauucacguagcaccucacugucugugucacuaguauuagugggagucgugacauuguacuugggaguuauggugcaggcugauagugguuguguugugaguuggaaaaacaaagaacugaaauguggcagugggauuuucaucacagacaauguacacacauggacagaacaauacaaauuccaaccagaaucccccucaaagcuggcaucagcuauccagaaagcucaugaagaaggcauuuguggaauccgcucaguaacaagacuggagaaucuaauguggaaacaaauaacaccagaacugaaucacauucuaucagaaaaugagguaaaguugucuaucaugacaggggacaucaaaggaaucaugcaggcaggaaaacgaucccugcggccucagcccacugagcucaaauauucauggaaaacguggggcaaagcgaaaaugcucuccacagagccucauaaccagaccuuucucauugauggccccgaaacagcagaaugucccaacacaaacagagcuuggaacucacuagaaguugaagacuauggcuuugggguauucaccaccaacauauggcugaaguugaaagaaaggcaggaugugucuugugacucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacacacucucuggaguaacggagugcuagaaagugagaugauaauuccaaagaauuuugcuggaccaguaucgcaacauaauuacagaccaggcuaucacacacaaacggcaggaccuuggcaucuaggcaagcuugagauggacuuugauuuuugcgaaggaaccacagugguggugacugaggacugcggaaauagaggacccucucuaagaacaacuacugcuucuggaaaacucauaacagaauggugcugccgauccugcacauuaccaccacuaagauacagaggcgaggauggaugcugguacggaauggaaaucagaccauugaaagagaaagaagagaacuuggucaauucuuuggucacagccggacauggacagaucgacaacuucucacuaggagucuugggaauggcacuguuccuggaagaaaugcucaggacccgaguaggaacaaaacaugcaguauuacugguugcaguuucuuucaugacauugaucacagggaacaugucuuuccgagaccuggggagagugaugguuauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccacaccagagaguauacuugaacugacugaugcguuggcuuugggcaugaugauucucaagauagugagaaacauggaaaaguaucaauuggcagugacuaucauggcuaucuuauguguuccaaaugcagugauauuacaaaaugcauggaaagugagcugcacaauacuggcagcgguguccguauccccacugcucuuaacaucuucgcagcagaaagcggauuggauaccauuggcauugacgaucaaaggucucaauccaacagccauuuuccuaacaacccuuucaagaacuaacaagaaaaggaguuggccacuaaaugaggcuaucauggcagucgggauggugagcauuuuagcuaguucucuuuugaagaaugacauucccaugacaggaccauuaguggcuggagggcuucucacuguguguuacgugcucacuggaagaucggccgaccuggaacuagagaaagccgccgacguuagaugggaagaucaggcagaaauaucaggaagcaguccaauucuaucaauaacaauaucggaagauggcagcaugucgauaaaaaaugaagaggaagaacaaacacugaccauacucauuagaacaggauugcuggugauaucaggacuuuuccccguaucaauaccaaucacggcagcagcaugguaccugugggaagugaagaaacaacgggcuggaguauugugggacguuccuucacccccaccugugggaaaggccgaacuggaagauggagcuuacagaaucaagcagaaagggauucuuggauacucccagaucggagcuggaguuuacaaagaaggaacauuccacacaauguggcacguuacacguggugcuguucuaaugcacaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuuuaagacuaacaccggaaccauaggcgcugugucccuagacuuuucuccuggaacaucaggaucuccaaucgucgacaaaaaaggaaaagucgugggucucuaugguaauggugucgucacaaggaguggaacauaugugagugccauagcccagacugaaaaaagcauugaagacaauccagagauugaagaugauaucuuucgaaaaaaaagauugaccauuauggaccuccauccaggagcgggaaagacgaaaagauaccuuccagcaauaguuagagaagccauaaaacgaggcuuaagaacauuaauccuggcccccacuagagucguggcagcugaaauggaagaagcucuuagaggacuuccgauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagcuagaggauacauuucaacucgaguagagaugggugaagcagcugggauuuucaugacagccacucccccgggaagcagagacccauuuccucaaagcaaugcaccaaucauggaugaagaaagggaaaucccugaacguucguggaacucuggacaugaguggguuacagauuucaaagggaagacuguuugguuuguuccgaguauaaaagcagguaaugauauagcagcuugccugaggaaaaauggaaagaaagugauacaacucaguaggaagaccuuugauucugaauacaucaagaccaggaccaaugauugggacuuuguggucacgacugacauuucagaaaugggugcuaacuucaaggcugaaaggguuauagaccccaggcgcugcaugaaaccagucauacuaacggacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugcuauugauggugaauaccgcuuaagaggagaagcgaggaaaaccuuuguggaucuaaugagaagaggagacuuaccagucuggcuggccuacagaguggcagccgaaggcauuaacuaugcagacagaaggugguguuuugauggaauuaagaacaaccaaaucuuagaagaaaauguggaaguggaaaucuggacaaaagaaggggaaaggaagaaacugaaacccagauggcuggaugcucggaucuacucugacccacuggcgcucaaagaauucaaagaguuugcagcuggaagaaaaucccugacccugaauuuaaucacggaaauggguaggcuuccaacuuuuaugacucagaaagcaaggaacgcacuggacaacuuagcaguccugcacacggcugaagcaggcggaagggcguacaaucaugcucucagugaacugccagagacucuggagacauugcuuuugcugacacuuuuggccacagucacgggcggaaucuuuuuauucuugaugaguggcaaagguauagggaaaaugacccugggaaugugcugcauaaucacggccaguauucuccuaugguacgcacaaauacagccacacuggauagcagccucaauaauacuggaguuuuuucucauagucuugcucauuccagagccagaaaagcaaagaacaccccaagacaaccaauugacuuacguuguuauagccauccucacagugguggccgcaaccauggcaaaugagaugggguucuuggaaaaaacgaagaaagauuucggauugggaagcauugcaauccagcaacccgagagcaacauccuggacauagaucuacguccugcaucagcauggacccuguaugcaguggccacaacauuuaucacaccaauguugagacacagcauugaaaauuccucagugaacgugucucuaacagccauugcuaaucaagccacagugcugaugggucuugggaaaggauggccauugucgaaaauggacauuggaguuccccuucucgccaucgggugcuauucacaagucaaccccauaacccucacagcagcccuucuuuuauugguagcacauuacgcuaucauagggccaggacuccaagcuaaagcaaccagagaagcgcagaaaagagcagcagcaggcaucaugaaaaacccaacuguggauggaguaacagugauugaccuagauccaauacccuaugacccaaaauuugagaagcagcugggacaaguaaugcuccuaguccucugcgugacucaaguacugaugaugaggacuacaugggcuuugugugaggcucuaaccuuagcgaccgggcccaucuccacauugugggaaggaaauccagggagauucuggaacacaaccauugcagugucaauggcuaacauuuuuagaggaaguuaccuagcuggagcuggacuucucuuuuccaucaugaagaauacaaccaacacaagaaggggaacuggcaacacaggagagacgcuuggagagaaauggaaaaaccgauugaauucauuggggaagagugaauuccagauuuacaagagaagcggaauucaggaaguggauagaaccuuggcaaaagaaggcauuaaaagaggagaaacggaccaucaugcugugucgcgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugaugucuucuuuacuccaccagaaaaaugugacacauuguugugugauauaggggagucgucaccaaaucccacgguugaagcuggacgaacacucagaguccuaaacuugguagaaaacuggcugaauaacaacacccaauuuugcauaaagguucuuaacccauacaugcccucaguuauagaaaaaauggaaacgcugcaaaggaaauacggaggagcuuuggugaggaauccccucucaagaaauuccacacaugagauguauuggguguccaaugcuuccgggaacauagugucaucagugaacaugauuucaaggauguugaucaauagauuuacaaugagacauaagaaggccacauacgagccagauguugaccucggaagcggaacccgcaacaucggaaucgaaagugagacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccauggugaauggaguaguuagacugcugacaaaaccuugggacgucaucccuauggugacacagauggcaaugacagacacgaccccauuuggacaacagcguguuuucaaagagaaaguggacacgagaacucaagaaccgaaagaaggcacgaagaaacuaaugaaaaucacggccgaauggcucuggaaagaacuagggaagaaaaagacaccuaggaugugcacuagagaagaauucgcaagaaaggugagaagcaaugcagcccuaggugccauauucacugaugagaacaaguggaagucggcacgugaggcuguugaagacaguagauuuugggaacuaguugacaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuucugaaugaagaucacugguuuuccagagagaacucucugagcggaguggaaggagaagggcugcacaagcuggguuacauucuaagagaagugagcaagaaagaaggaggagcaauguacgccgacgacacagcaggaugggauacaagaaucacacuagaggaccuaaaaaaugaagagaugguaacaaaccauauggaaggagaacacaagaaacuugcugaggccaucuucaaauuaacauaccaaaacaagguggugcgugugcaaagacccacaccaagaggcacaguaauggauauuauaucgagaagagaccaaagagguaguggacaaguuggcaccuauggucucaacaccuuuaccaauaugggagcccaacuaaucagacagauggagggagagggagucuuuaaaggcauccagcaucugacagccacagaagaaguugcagugcaagacugguuagcaagaguggggcgugagagguuaucaagaauggccaucaguggagaugauuguguugugaaacccuuagaugacagguuugcaagcgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucgugguuccauguagaaaccaagaugaacugauugguagagcucgaauuucccagggagccggguggucucugcgggagacggccugucuggggaagucuuacgcccaaauguggagccugauguacuuccacagacgugaccucaggcuggcagcaaacgcuaucugcucggcaguuccaucacauuggguuccgacaagucgaacaaccugguccauacacgccggacaugaauggaugacaacagaagacaugcugacagucuggaacaggguguggauucaagaaaacccauggauggaagacaaaacuccaguggaaucaugggaggaaaucccauacuugggaaaaagagaagaccaauggugcggcucauugauaggguuaacaagcagggccaccugggcaaggaacauccaaacagcaauaaaccaaguuagauccuuaauaggcagugaggaauacacagacuacaugccauccaugaaaagauucagaagagaagaggaagaggcaggggucuugugguag

SEQ ID NO: 7014 - RNA, 9876 nt, Artificial Sequence
  derived and/or modified CDS sequence (wt) from DENV-2__FM210231__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaacgagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacucuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucgaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucaccggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugcuuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccagccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaagaaaugcuuaggacccgaguaggaacgaagcaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugguauuacaaaaugcauggaaagugaguugcacaauacuggcagugguguccguuuccccacugcuuuugacauccucacagcaaaaaacggauuggauaccauuagcauugacaaucaagggucucaauccaacagccaucuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucaaagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacucaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucuaacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauuguaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggccuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaagcguaagagaagugaaaggccuaacaaaaggaggaccaggacacgaagaacccauuccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccugggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaauuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaacuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauccgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 7015 - RNA, 9876 nt, Artificial Sequence
  derived and/or modified CDS sequence (wt) from DENV-2__FM210239__SS-prME
acagcaggcgugauuauuauguuaauuccaacagcgauggcguuccauuuaaccacacgaaauggagaaccacacaugaucguuggcagacaagagaaagggaaaagucuucuguuuaaaacagaggauggugugaacauguguacccucauggccauugaccuuggugaauugugugaagauacaaucacguacaagugcccccuccucaggcagaaugaaccagaagacauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggaucuugagacauccaggcuuuaccauaauggcagcaauccuggcauacaccguaggaacgacacauuuccaaagggcccugauuuucaucuuauuggcagcugucgcuccuucaaugacaaugcguugcauaggaauaucaaauagagacuuuguagaagggguuucaggaggaagcuggguugacauagucuuagaacauggaaguugugugacgacgauggcaaaaaauaaaccaacacuggauuuugaacugauaaaaacagaagccaaacaaccugccacucuaaggaaguacuguauagaggcaaagcugaccaauacaacaacagaaucucguugcccaacacagggggaacccaguuuaaaugaagagcaggacaaaagguucgucugcaaacacuccaugguagacagaggauggggaaauggauguggauuauuuggaaagggaggcauugugaccugugcuauguucacauguaaaaagaacauggaaggaaaaaucgugcaaccagaaaauuuggaauacaccaucgugauaacaccucacucaggagaagagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaagcaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggacaaauguuugagacgacaaugagaggagcaaagagaauggccauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguugugagcuggaaaaacaaagaacugaaauguggcagcgggaucuucaucacagauaacgugcacacguggacagaacaauacaaguuccaaccagaauccccuucaaaauuagcuucagccauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaucagaccuuucucauugauggccccgaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauggcauuauuccuggaagaaaugcucaggacacgaguaggaacgaaacaugcaauacugcuaguuacaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuucgcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaagaauccaagagcuguccaaacgaaaccuggacuuuucaaaaccaacaccggaaccauaggcgccguaucuuuggacuuuuccccuggaacaucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagaguuguggcagcugaaauggaggaagcccuuagaggacuuccaauaagauaccaaaccccagccaucagagccgagcacaccgggcgggagauuguggaccuaaugugucaugccacauucacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagccaaaaugcuccuagacaacaucaacacaccugaaggaaucauuccuaguauguucgaaccagagcgugaaaagguggaugccauugauggugaauaccgcuugagaggagaagcaaggaggaccuuuguggaccuaaugagaagaggggacuuaccagucuggcuggcuuacagaguggcagcugaaggcaucaacuacgcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuggauaaccuagcugugcugcauacggcugaggcagguggaagggcguacaaucaugcucucagugaacugccggagacccuggagacacuacuuuuacugacacuccuggcuacagucacgggaggaauuuucuuauucuuaaugagcggaaaagguguagggaagaugacccuaggaaugugcugcauaaucacggcuagcauccuccuaugguacgcacagauacaaccacacuggauagcagcuucaauaauauuggaguuuuuucucauaguuuugcucauuccagaaccagaaaaacagagaacaccccaagauaaccaacugaccuacguuguuauagccauccucacagugguggccgcaaccauggcaaacgagauggguuuccuagaaaaaacuaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugccaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuccaagcgaaagcaaccagagaagcucagaaaagagcagcagcaggcaucaugaaaaacccaacagucgauggaguaacagugauugaccuagauccaauacccuaugauccaaaauuugaaaaacagcuaggacaaguaaugcuccugauucucugcgugacucaaguacuaaugaugaggacuacaugggcuuugugugaggcucuaaccuuagcgaccgggcccaucuccacauugugggaagguaauccagggagauuuuggaacacuacuauugcagugucaauggccaacauuuuuagagggagcuacuuagcuggagcuggacuucuuuuuuccaucaugaagaacacaacaaauacaagaagaggaacuggcaacauaggagagacgcuuggagagaaauggaaaagccgauuaaacgcacuggggaaaagugaauuucagaucuacaagaaaaguggaauccaggaaguggauagaaccuuagcaaaagaaggcaucaaaagaggagaaacggaccaccacgcugugucgcgagguucagcaaaacugagaugguucgucgagagaaauauggucacaccagaaggaaaagugguggaccuugguugcggcagagggggcuggucauacuauugugggggacuaaaggauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucagugaacaugaucucaaggaugcugauuaacagauucacaaugaaacacaagaaagccaccuacgagccagauguugacuuagggagcggaacccgcaacauuggaauugaaagugagauaccaaaucuagacauaauaggaaagagaauagagaaaauaaaacaagagcaugaaacaucauggcacuaugaccaagaccacccauacaaaacaugggcuuaccauggcagcuaugaaacaaaacaaacuggaucagcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaggugagaagcaaugcagccuugggggccauauucacugaugagaacaaauggaagucggcacgcgaggcuguugaagauagcagguuuugggagcugguugacaaggaaagaaaucuccaucuugaagggaagugugaaacauguguguacaacaugaugggaaagagagaaaagaaacuaggggaguucgguaaggcaaaggguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucgguaccuauggccucaacacuuucaccaauauggaagcccaauuaauuagacagauggagggagaaggaguuuucaaaagcauucagcgccugacagucacagaagaaauugcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggauggucuuugaaggagacggccuguuuggggaaguccuacgcucaaauguggagucugauguacuuccacagacgugaccucaggcuggcggcaaaugcuauuugcucggcagucccgucacauugggucccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 7016 - RNA, 9876 nt, Artificial Sequence
  derived and/or modified CDS sequence (wt) from DENV-2__FM210232__SS-prME
acagcaggcgugauuauuauguuaauuccaacagcgauggcguuccauuuaaccacacgaaauggagaaccacacaugaucguuggcagacaagagaaagggaaaagucuucuguuuaaaacagaggauggugugaacauguguacccucauggccauugaccuuggugaauugugugaagauacaaucacguacaagugcccccuccucaggcagaaugaaccagaagacauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggaucuugagacauccaggcuuuaccauaauggcagcaauccuggcauacaccguaggaacgacacauuuccaaagggcccugauuuucaucuuauuggcagcugucgcuccuucaaugacaaugcguugcauaggaauaucaaauagagacuuuguagaagggguuucaggaggaagcuggguugacauagucuuagaacauggaaguugugugacgacaauggcaaaaaauaaaccaacacuggauuuugaacugauaaaaacagaagccaaacaaccugccacucuaaggaaguacuguauagaggcaaagcugaccaauacaacaacagaaucucguugcccaacacagggggaacccaguuuaaaugaagagcaggacaaaagguucgucugcaaacacuccaugguagacagaggauggggaaauggauguggauuauuuggaaagggaggcauugugaccugugcuauguucacauguaaaaagaacauggaaggaaaaaucgugcaaccagaaaauuuggaauacaccaucgugauaacaccucacucaggagaagagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaagcaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacagucaauccgaucguaacagaaaaagauagcccagucaacauagaagcagaaccuccauucggagacagcuacaucauuauaggaguagagccgggacaauugaaacucaacugguucaagaaaggaaguuccaucggacagauguuugagacaacaaugagaggagcaaagagaauggccauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguugugagcuggaaaaacaaagaacugaaauguggcagcgggaucuucaucacagauaacgugcacacguggacagaacaauacaaguuccaaccagaauccccuucaaaauuagcuucagccauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacagcacaauuacagaccaggcuauuacacgcaaacagcaggaccuuggcaucuagguaagcuugagauggacuuugauuucugcgaaggaacuacagugguggugacugaggccugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauggcauuauuccuggaagaaaugcucaggacacgaguaggaacgaaacaugcaauacugcuaguuacaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuucgcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaagaauccaagagcuguccaaacgaaaccuggacuuuucaaaaccaacaccggaaccauaggcgccguaucuuuggacuuuuccccuggaacaucaggaucuccaauugucgauagaaaaggaaaaguugugggucuuuauggcaaugguguugucacaaggaguggagcauacgugagugccauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagaguuguggcagcugaaauggaggaagcccuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaggcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaauaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucuggcuggcuuacagaguggcagcugaaggcaucaacuaugcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuggauaaccuagcugugcugcauacggcugaggcagguggaagggcguacaaucaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuaugguaugcacagauacaaccacacuggauagcagcuucaauaauauuggaguuuuuucucauaguuuugcucauuccagaaccagaaaaacagagaacaccccaagauaaccaacugaccuacguuguuauagccauccucacagugguggccgcaaccauggcaaacgagauggguuuccuagaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuccaagcgaaagcaaccagagaagcucagaaaagagcagcagcaggcaucaugaaaaacccaacagucgauggaguaacagugauugaccuagauccaauacccuaugauccaaaauuugaaaaacagcuaggacaaguaaugcuccugauucucugcgugacccaaguacuaaugaugaggacuacaugggcuuugugugaggcucuaaccuuagcgaccgggcccaucuccacauugugggaagguaauccagggagauuuuggaacacuacuauugcagugucaauggccaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacuggggaaaagugaauuucagaucuacaagaaaaguggaauccaggaaguggauagaaccuuagcaaaagaaggcaucaaaagaggagaaacggaccaccacgcugugucgcgagguucagcaaaacugagaugguucgucgagagaaauauggucacaccagaagggaaagugguggaccuugguugcggcagagggggcuggucauacuauugugggggacuaaaggauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaauaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucagugaacaugaucucaaggaugcugauuaacagauucacaaugaaacacaagaaagccaccuacgagccagauguugacuuagggagcggaacccgcaacauuggaauugaaagugagauaccaaaucuagacauaauaggaaagagaauagagaaaauaaaacaagagcaugaaacaucauggcacuaugaccaagaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaggugagaagcaaugcagccuugggggccauauucacugaugagaacaaauggaagucggcacgcgaggcuguugaagauagcagguuuugggagcugguugacaaggaaagaaaucuccaucuugaagggaagugugaaacauguguguacaacaugaugggaaagagagaaaagaaacuaggggaguucgguaaggcaaaggguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucgguaccuauggccucaacacuuucaccaauauggaagcccaauuaauuagacagauggagggagaaggaguuuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggauggucuuugaaggagacggccuguuuggggaaguccuacgcucaaauguggagucugauguacuuccacagacgugaccucaggcuggcggcaaaugcuauuugcucggcagucccgucacauugggucccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 7017 - RNA, 9876 nt, Artificial Sequence
  derived and/or modified CDS sequence (wt) from DENV-2__FM210233__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguggaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacguagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucagaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauggaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcagucucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauacccuuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaagaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugaaaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauaggaaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagagggaucuuggauuaggaagcauugcaacccagcaacccgagagcaacauccuggacauagaccuacgucccgcaucagcuuggacgcuguaugccguggcuacaacauucguuacaccaaugcugagacacagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcgaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauaccuucaccaauauggaagcccaauuaaucagacagauggagggagaaggagucuuuaaaaacauccagcaccugacagucacagaagaaguugccgugcauaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagacauacaacaaugggaaccuucaaaaggauggaacgauuggacacaagugcccuucuguucacaccauuuucaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 7018 - RNA, 9876 nt, Artificial Sequence
  derived and/or modified CDS sequence (wt) from DENV-2__FM210241__SS-prME
acagcaggcgugauuauuauguugauuccaacagcgauggcguuccaucuaaccacacguaauggagaaccacacaugaucguugguagacaagagaaagggaaaagucuucuguucaaaacggaggauggugugaacauguguacccucauggccauagaucuuggugaauugugugaagauacaaucacguacaagugcccccuccucaggcagaaugaaccagaagacauagauuguugguguaacuccacguccacauggguaacuuaugggacaugcaccaccacaggagaacacagaagagaaaaaagaucaguggcacucguuccacauguggguaugggacuggagacacgaacugaaacauggaugucgucagaaggagccuggaaacacgcucagagaaucgaaaccuggaucuugagacauccaggcuuuaccauaauggcagcaauccuggcauacaccauaggaacgacacauuuccaaagggcccugauuuucaucuuacugacagcugucgcuccuucaaugacaaugcguugcauaggaauaucgaauagagacuuuguagaagggguuucaggaggaagcuggguugacauagucuuagaacauggaaguugugugacgacaauggcaaaaaacaaaccaacauuggauuuugaacugauaaaaacagaagccaaacaaccugccacuuuaaggaaguacuguauagaagcaaagcugaccaacacaacaacagaaucucguugcccaacacaaggggaacccagucuaaaugaagagcaggacaaaagguucgucugcaaacacuccaugguggauagaggauggggaaauggauguggauuauuuggaaaaggaggcaucgugaccugugcuauguuuacaugcaaaaagaacauggaaggaaaaaucgugcagccagaaaauuuggaauacaccaucgugauaacaccucacucaggagaagagcaugcuguagguaaugacacaggaaaacaugguaaggaaaucaaaauaacaccacagaguuccaucacagaagcagaacugacaggcuauggcacaguuacgauggagugcucuccgagaacgggccuugacuuuaaugagauggugcugcugcagauggaagacaaagcuuggcuggugcacaggcagugguuccuagaccugccguuaccauggcuacccggagcggacacacaaggaucaaauuggauacagaaagagacacuggucacuuucaaaaauccccacgcaaagaaacaggaugucguuguuuuaggaucucaagaaggggccaugcacacggcacucacaggggccacagagauccagaugucaucaggaaacuuacuauucacaggacaucucaagugcaggcugagaauggacaaacuacagcucaaaggaaugucauacucuaugugcacaggaaaguucaaaauugugaaggaaauagcagaaacacaacauggaacaauaguuauuagaguacaauaugaaggagacggcucuccauguaagaucccuuuugaaauaauggauuuagaaaaaagacaugucuuaggucgccugauuacagucaacccgaucguaacagaaaaagauagcccagucaacauagaagcagaaccuccauucggagacagcuacaucauuauaggaguagagccgggacaauugaaacucaacugguuuaagaaaggaaguuccauuggccaaauguuugagacaacaaugagaggagcgaagaggauggccauuuuaggugacacagccugggauuuuggaucccuaggaggaguguuuacaucuauaggaaaagcucuccaccaaguuuucggagcaaucuauggggcugccuuuaguggggucucauggacuaugaaaauccucauaggagccaucaucacauggauaggaaugaauucacguagcaccucacugucugugucacuaguauuggugggagucauaacacuguacuugggagccauggugcaggcugauagugguugcguugugagcuggaaaaacaaagaacugaaauguggcagcgggaucuucaucacagauaacgugcacacauggacagaacaauacaaguuccaaccagaauccccuucaaaauuagcuucagcuauccagaaagcucaugaagagggcauuugugggauucgcucaguaacaagauuggagaaucugauguggaaacaaauaacaccagaauugaaccacauucuaucagaaaaugagguaaaguugaccaucaugacaggagauauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuauggcuuuggaguuuucaccaccaacauauggcuaaaauugagagaaaaacaggauguguuuugugacucaaaacucaugucagcagccauaaaagacaacagagccguccaugccgauauggguuacuggauagaaagugcacucaaugacacauggaagauggaaaaggccuccuucauugaaguuaaaagcugccacuggccaaaaucacacacccucuggagcaauggaguauuagaaagugagaugauaauuccaaaaaguuuugcugggccagugucacaacacaacuacagaccaggcuauuacacgcaaacagcaggaccuuggcaucuagguaagcuugaaauggacuuugauuucugcgaaggaacuacagugguggugacugaggacugcggaaauagaggacccucuuuaagaacgaccacugccucuggaaaacuuauaacagaauggugcugccgauccugcacauuaccaccucuaagauacagaggugaggauggaugcugguaugggauggaaaucagaccauuaaaagagaaagaagagaauuuggucaacuccuuggucacagcaggacaugggcagauugacaacuucucacuaggagucuugggaauggcacuauucuuggaagaaaugcucaggacacgaguaggaacgaaacaugcaauacugcuaguugcaguuuccuuugugacauugauuacugggaacauguccuucagagaccugggaagagugaugguuauggugggcgcuaccaugacggaugacauagguaugggagugacuuaucuugcccuacuagcagcuuucaaaguuagaccaacuuuugcagcuggacuacuacugagaaagcugaccuccaaggaauuaaugauggcuaccauaggaauugcacuccuuucucaaagcaccauaccagagaccauucuugaacuaacugaugcguuagccuugggcaugaugguccuuaaaauagugagaaauauggaaaaguaccaauuggcagugacuaucauggcuaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaggcuaucauggcugucgggauggugagcauuuuggccaguucccucuuaaagaaugacauucccaugacagguccauuaguggcuggagggcuccuuacugugugcuacgugcucacuggacgaucggccgacuuggaacuggagagagccaccgaugucaaaugggaagaucaggcagaaauaucaggaagcagcccaauccugucaauaacaauaucagaagauggcagcaugucgauaaagaaugaagaggaagaacaaacacugaccauacucaucagaacgggauugcuagugaucucaggacucuuuccagugucaauaccaauuacggcagcagcaugguaccugugggaagugaagaaacaacgggcuggaguauugugggacgucccuucacccccacccgugggaaaggcugaacuggaagauggagccuauagaaucaagcagaaagggauucuuggauacucucagauuggagccggaguuuacaaagaaggaacauuccauacaauguggcacgucacacgcggcgcuguucugaugcauagagggaagaggauugaaccaucaugggcggacgucaagaaagaccuaauaucauauggaggaggcuggaaacucgaaggagaauggaaggaaggagaggaaguccaaguccuggcauuggaaccuggaaaaaauccaagagcuguccaaacgaaaccuggacuuuucaaaaccaacaccggaaccauaggcgccguaucucuggacuuuucuccuggaacgucaggaucuccaauugucgacagaaaaggaaaaguugugggucuuuauggcaaugguguugucacaaggaguggagcauacgugagugcuauagcccagaccgaaaaaagcauugaagacaauccagagauugaagaugacauuuuccgaaagaaaagauugacuaucauggaccuccauccaggagcgggaaagacaaaaagauaccuuccagccauaguuagagaggccauaaaacguggcuuaagaacauuaauccuggcccccacuagagucguggcagcugaaauggaggaagcucuuagaggacuuccaauaagauaccaaaccccagccaucagagccgagcauaccgggcgggagauuguggaccuaaugugucaugccacguuuacuaugaggcugcuaucaccagucagagugccaaauuacaaccugaucaucauggaugaagcucacuucacagacccagcaaguauagcagcuagaggauacauuucaacucgaguagagaugggugaggcagcugggauuuucaugacagccacuccuccgggaaguagagacccauuuccucagagcaaugcaccaaucauagaugaggaaagagaaaucccugagcgcucguggaacucuggacaugaaugggucacggauuuuaaagggaagacuguuugguuuguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacguugcaugaaaccagucauacuaacagauggugaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcgcauuggaaagaagcuaaaaugcuccuagauaacaucaacacaccugaaggaaucauuccuaguauguucgaaccagagcgugaaaagguggaugccauugauggugaauaccgcuugagaggagaagcaaggaaaaccuuuguggaccuaaugagaagaggggacuuaccagucuggcuggccuacagaguggcagcugaaggcaucaacuacgcagacagaaggugguguuuugauggaguuaagaauaaccaaauacuggaagaaaacguggaaguggaaauuuggacaaaagagggagaaaggaagaaauuaaaacccagaugguuggacgcuaggaucuauucugacccacuggcacuaaaagaauucaaggaauuugcagcuggaagaaagucccuaacccugaaccuaaucacagaaauggguaggcuuccaacuuucaugacucaaaaagcaagagacgcacuggauaaccuagcugugcugcauacggcugaggcagguggaagagcguauaaucaugcucucagugaacugccggagacccuggagacacugcuuuuacugacacuucuggcuacaguuacgggaggaaucuucuuauucuuaaugagcggaaaagguguagggaagaugacccugggaaugugcugcauaaucacggcuagcauccuccuaugguaugcacagauacaaccacacuggauagccgcuucaauaauauuggaguuuuuucucauaguuuugcucauuccagaaccagaaaaacagagaacaccccaagauaaccaauugaccuacguugucauagccauccucacaguaguggccgcaaccauggcaaacgaaauggguuuucuggaaaaaaccaagaaagaccucggauugggaagcauugcaacccaggaaccugagagcaacauccuggacauagaucuacguccugcgucagcauggacgcuguacgccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuccuugccauuggauguuacucacaagucaaccccauaacucucacagcagcucuucuuucauugauagcacauuaugccauuauagggccaggacuucaagcgaaagcaaccagagaagcucagaaaagagcagcagcaggcaucaugaaaaacccaacagucgauggaauaacagugaucgaccuagauccaauacccuaugauccaaaauuugaaaaacaguugggacaaguaaugcuccuaauucucugcgugacucaaguauuaaugaugaggacuacaugggcucugugugaggcucuaaccuuagcgaccgggcccaucuccacauugugggaaggcaauccagggagguuuuggaacaccaccauugcagugucaauggcuaacauuuuuagagggagcuacuuggcuggagcuggacuucuuuuuuccaucaugaagaauacaacaaauacaagaagaggaacuggcaacauaggagagacgcuuggagagaaauggaaaagccgauugaacgcacugggaaaaagugaauuucagauuuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacuaaagaauguaagagaagucaaaggccugacaaaaggaggaccaggacacgaggaaccuauccccaugucaacauauggguggaaucuaguacgucugcagaguggaguugauguuuucuucacuccgccagaaaagugugacacacuguugugugacauaggggagucgucaccaaaucccacgauagaagcaggacgaacacucagaguccuuagcuugguggaaaauugguugaacaaugacacucaauuuugcauaaagguucucaacccauacaugcccucaguuauagaaaaaauggaaacacugcagaggaaauauggaggagccuuagugaggaauccacucucacgaaacuccacacaugagauguacuggguauccaaugcuacugggaacauagugucaucagugaacaugauuucaaggaugcugauuaacagauucacaaugaaacacaagaaagcuaccuacgagccagauguugaccuagggagcggaacccgcaacauuggaauugaaagugagauaccaaaucuagacauaauaggaaagagaauagagaaaauaaagcaagagcaugaaacaucguggcacuacgaccaagaccacccauauaaaacaugggcuuaccauggcagcuaugaaacaaaacagacuggaucagcaucauccauggugaacggaguggucagacuacugacaaaaccuugggacgucgucccuaugguaacacagauggcaaugacagauacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggggccauauucacugaugagaacaaauggaagucggcacgcgaggcuguugaagauaguagguuuugggagcugguugacaaggaaaggaaucuccaucuugaaggaaagugugaaacauguguguacaacaugaugggaaagagagaaaagaaacuaggggaguucggcaaggcaaaagguagcagagccauaugguacauguggcuuggagcacgcuucuuggaguuugaagcccugggauucuugaaugaagaucacugguucucuagagagaacucccugaguggaguggaaggagaagggcugcacaagcuaggcuacauucuaagagacgugagcaagaaggaaggaggagcaauguacgccgaugauacagcaggaugggacacaagaaucacacuagaggacuuaaaaaaugaagaaauggugacaaaccacauggaaggagaacacaagagacuagccgaggccauauuuaaacuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuuaucagacagauggagggagaaggaauuuucaaaagcauucagcaccugacagucacagaagaaaucgcuguacagaacugguuggcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucaaaaggauggaacgauuggacacaagugccuuuuuguucacaccauuuucaugaguuaaucaugaaagacggccgcgugcuugugguuccaugcagaaaccaagaugaacugauuggcagggcccgaauuucccagggagcuggguggucuuugaaggagacggccuguuuggggaagucuuacgcccaaauguggagccugauguacuuccacagacgugaccucaggcuggcggcaaaugcuauuugcucggcagucccgucacauuggguuccuacaagucggacaaccuggucuauacacgccaaacaugaauggaugacgacggaagacaugcugacagucuggaacaggguguggauccaagaaaacccauggauggaagacaaaacuccaguggagucaugggaggaagucccauauuugggaaaaagagaagaccaauggugcggcucauugauugggcuaacaagcagggcuaccugggcaaagaauauccaaacagcaauaaaucaagucagaucccuuauaggcaaugaagaauacacagauuauaugccauccaugaagagauucagaagggaagaggaagaggcagguguccugugguag

SEQ ID NO: 7019 - RNA, 9876 nt, Artificial Sequence
  derived and/or modified CDS sequence (wt) from DENV-2__FM210242__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaacgagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacucuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucgaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucaccggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugcuuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccagccagaauccccuucaaaacuagcuucagcuauccagaaagcucaagaagagggaauuugugggauccgcucgguaacaagauuggagaaccuaauguggaaacaaauaacaccagaacugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaagaaaugcuuaggacccgaguaggaacgaagcaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugguauugcaaaaugcauggaaagugaguugcacaauacuggcagugguguccguuuccccacugcuuuugacauccucacagcaaaaaacggauuggauaccauuagcauugacaaucaagggucucaauccaacagccaucuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucacacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucaaagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacucaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucuaacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaagcguaagagaagugaaaggccuaacaaaaggaggaccaggacacgaagaacccauuccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccugggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaauuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaacuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauccgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 7020 - RNA, 9876 nt, Artificial Sequence
  derived and/or modified CDS sequence (wt) from DENV-2__FM210243__SS-prME
acagcaggcgugauuauuauguuaauuccaacagcgauggcguuccauuuaaccacacgaaauggagaaccacacaugaucguuggcagacaagagaaagggaaaagccuucuguuuaaaacagaggauggugugaacauguguacccucauggccauugaucuuggugaauugugugaagauacaaucacguacaagugcccccuccucaggcagaaugaaccagaagauauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaacuuggaucuugagacauccaggcuuuaccauaauggcagcaauccuggcauauaccguaggaacgacacauuuccaaagggcccugauuuucaucuuacuggcagcugucgcuccuucaaugacaaugcguugcauaggaauaucaaauagagacuuuguagaagggguuucaggaggaagcuggguugacauagucuuagaacauggaaguugugugacgacaauggcaaaaaauaaaccaacacuggauuuugaacugauaaaaacagaagccaaacaaccugccacucuaaggaaguacuguauagaggcaaagcugaccaauacaacaacagaaucucguugcccaacacaaggggaacccagucuaaaugaagagcaggacaaaagguucgucugcaaacacuccaugguagacagaggauggggaaauggauguggauuauuuggaaagggaggcauugugaccugugcuauguucacaugcaaaaagaacauggaaggaaaaaucgugcaaccagaaaauuuggaauacaccaucgugauaacaccucacucaggagaagagcacgcuguagguaaugacacaggaaaacaugguaaggaaauuaaaauaacaccacagaguuccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaagcaggaugucguuguuuuaggaucucaagaaggagccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggccaaauguuugagacgacaaugagaggagcaaagagaauggccauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucacuaguauuggugggaaucauaacacuguacuugggagcuauggugcaggcugauagugguugcguugugagcuggaaaaacaaagaacugaaauguggcagcgggaucuucaucacagauaacgugcauacguggacagaacaauacaaguuccaaccagaauccccuucaaaauuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggcccugaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuacuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauggcacuauuccuggaagaaaugcucaggacacgaguaggaacgaaacaugcaauacugcuaguuacaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuucgcagcuggacuacuacugagaaagcugacuuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuuuuccacugcucuuaacauccucacagcagaaagcggauuggauaccacuggcauugacgauaaaaggucucaauccaacagccauuuuuuuaacaacccuuucgagaacuagcaagaaaaggagcuggccgcuaaaugaggccaucauggcagucgggaugguuagcauuuuagccaguucucucuuaaaaaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaaaaauccaagagcuguccaaacgaaaccuggacuuuucaaaaccaacaccggaaccauaggcgccguaucuuuggacuuuuccccuggaacgucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagcuauaguuagagaggccauaaaacguggcuugagaacauuaauccuggcccccacuagagucguggcagcugaaauggaggaggcucuuagaggacuuccaauaagauaccaaaccccagccaucagagccgagcacaccggacgggagauuguggaccuaaugugucacgccacauuuaccaugagacugcuaucaccagucagagugccaaauuacaaccugaucaucauggaugaagcucacuucacagacccagcaaguauagcagcuagaggauacauuucaacucgaguagagaugggugaggcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucugguuggcuuacaggguggcagcugaaggcaucaacuacgcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaaugggcagacuuccaacuuucaugacccagaaggcaagagacgcacuggauaaccuagcugugcugcauacggcugaggcagguggaagggcguacaaucaugcucucagugaacugccggagacccuggagacacuacuuuuacugacacuccuggcuacagucacgggaggaauuuuccuauucuuaaugagcggaaaagguguagggaagaugacccugggaaugugcugcauaaucacggcuagcauccuccuaugguaugcacagauacaaccacacuggauagcagcuucaauaauauuggaguuuuuucucauaguuuugcucauuccagaaccagaaaaacagagaacaccccaagauaaccaacugaccuacguugucauagccauccucacagugguggccgcaaccauggcaaacgagauggguuuccuggaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuucaagcgaaagcaaccagagaagcucagaaaagagcagcagcaggcaucaugaaaaacccaacagucgauggaauaacagugauugaccuagauccaauacccuaugauccaaaauuugaaaaacagcuaggacaaguaaugcuccugauucucugcgugacucaaguacuaaugaugaggacuacaugggcuuugugugaggcucuaaccuuagcgaccgggccuaucuccacauugugggaagguaauccagggagguuuuggaacacuacuauugcagugucaauggcuaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacugggaaagagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccuugguugcggcagagggggcuggucauacuauugugggggacuaaagaauguaagagaagucaaaggccugacaaaaggaggaccaggacacgaagaaccaauccccaugucaacauauggauggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucaguaaacaugaucucaaggaugcugauuaacagauucacaaugaaacacaagaaagccaccuacgagccagauguugacuuagggagcggaacccguaacauuggaauugaaagugagauaccaaaucuagacauaauaggaaagagaauagagaaaauaaaacaagagcaugaaacaucguggcacuaugaccaagaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggaugugcaccagagaagaauucacaagaaaagugagaagcaaugcagccuugggggccauauucacugaugagaacaaauggaagucggcacgcgaggcuguugaagauagcagguuuugggagcugguugacaaggaaagaaaucuccaucuugaagggaagugugaaacauguguguacaacaugaugggaaagagagaaaagaaacuaggggaguucggcaaggcaaaagguagcagagccauaugguacauguggcuuggagcacgcuucuuggaguuugaagccuugggauucuugaaugaagaucacugguucuccagagagaacucccugaguggaguggaaggagaagggcugcacaagcugggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuucaaauuaacguaccaaaacaagguggugcgugugcaaagaccaacaccaagaggcacaguaauggauaucauaucgaggagagaccaaagaggcagugggcaagucggcaccuauggccucaacacuuucaccaauauggaagcccaauuaauuagacagauggagggagaaggaauuuucaaaagcauucagcaccugacagucacagaagaaaucgcugugcagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcucguaguuccauguagaaaccaagaugaacugauuggcagggcccgaauuucccagggagcuggguggucuuugaaggagacggccuguuuggggaagucuuacgcucaaauguggagucugauguacuuccacagacgugaccucaggcuggcggcaaaugcaauuugcucggcagucccgucacauugggucccaacaagucgaacaaccuggucaauacacgccaagcaugaauggaugacgacggaagacaugcugacaguuuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 7021 - RNA, 9876 nt, Artificial Sequence
  derived and/or modified CDS sequence (wt) from DENV-2__FM210244__SS-prME
acagcaggcgugauuauuauguuaauuccaacagcgauggcguuccauuuaaccacacguaauggagaaccacacaugaucguuggcagacaagagaaagggaaaagucuucuguuuaaaacagaggauggugugaacauguguacccucauggccauugaucuuggugaauugugugaagauacaaucacguacaagugcccccuccucaggcagaaugaaccagaagauauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggauuuugagacauccaggcuuuaccauaauggcagcaauccuggcauacaccguaggaacgacacauuuccaaagggcccugauuuucaucuuacuggcagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacugaagccaaacaaccugccacucuaaggaaguacuguauagaggcaaagcugaccaauacaacaacagaaucucguugcccaacacaaggggaacccagucuaaaugaagagcaggacaaaagguucgucugcaaacacuccaugguagacagaggauggggaaauggauguggauuauuuggaaagggaggcauugugaccugugcuauguucacaugcaaaaagaacauggaaggaaaaaucgugcaaccagaaaauuuggaauacaccaucgugauaacaccucacucaggagaagagcacgcuguagguaaugacacaggaaaacaugguaaggaaauuaaaauaacaccacagagucccaucacagaagcagaacugacaggcuauggcacagucacgauggagugcucuccgagaacgggccucgacuucaaugagauggugcugcugcagauggaagauaaagcuuggcuggugcacaggcaaugguuccuagaccugccguuaccauggcuacccggagcggacacacaaggaucaaauuggauacagaaagagacacuggucacuuucaaaaauccccacgcgaagaaacaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggccaaauguuugagacaacaaugagaggagcaaagagaauggcuauuuuaggugacacagccugggauuuuggaucucugggaggaguguuuacaucuauaggaaaggcucuccaccaaguuuuuggagcaauuuauggggccgccuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguuguaagcuggaaaaacaaagaacugaaauguggcagcgggaucuucaucacagauaacgugcauacguggacagaacaauacaaguuccaaccagaauccccuucaaaauuagcuucagcuauccaaaaagcucaugaagaggguauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucccacaaccagaccuuucucauugauggcccugaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaaguuaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggacggaugcugguaugggauggaaaucagaccauuaaaagagaaagaagagaauuuggucaacucccuggucacagccggacaugggcagauugacaacuuuucacuaggagucuugggaauggcacuauuccuggaagaaaugcucaggacacgaguaggaacgaaacaugcaauacugcuaguugcaguuucuuuugugacauugaucacugggaacauguccuuuagagauuugggaagaguaaugguuauggugggcgcugccaugacggaugacauagguauaggagugacuuaucuugcccuacuggcagcuuucaaaguaagaccaacuuuugcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugaccaucauggccaucucgugugucccaaaugcagugauacugcaaaacgcauggaaggugagcugcacaauauuggcaacgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuugaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggaaguccaaguccuagcauuggaaccugggaaaaauccaagagcuguccaaacgaaaccuggacuuuucaaaaccaacaccggaaccauaggcgccguaucuuuggacuuuuccccuggaacgucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguugagaugggugaagcagcugggauuuucaugacagccacuccuccgggaaguaaagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacgcugcaugaaaccaguuauauuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucugguuggcuuacagaguggcagcugaaggcaucaacuaugcagacagaaggugguguuuugauggaguuaagaacaaccaaauacuagaagaaaacguggaaguggaaauuuggacaaaagaaggggaaaggaaaaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuagauaaccuagcugugcugcauacggcugaggcagguggaaaggcguacaaucaugcucucagugaacugccggagacccuugagacacuacuuuuacugacacuccuggcuacagucacgggaggaauuuucuuauucuuaaugaguggaaaagguguagggaagaugacccugggaaugugcugcauaauaacggcuagcauccuccuauggcaugcacagauacaaccacacuggauagcagcuucaauaauauuggaguuuuuucucauaguuuugcucauuccagagccagaaaaacagagaacaccccaagauaaccaacugaccuacguugucauagccauccucacagugguggccgcaaccauggcaaacgagauggguuuccuggaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuucaagcgaaagcaacuagagaagcucagaaaagagcagcagcaggcaucaugaaaaacccaacagucgauggaauaacagugauugaccuagauccaauacccuaugauccaaaauuugaaaaacagcuaggacaaguaaugcuccugauucucugcgugacucaaguauuaaugaugaggacuacaugggcuuugugugaggcucuaaccuuagcgaccgggcccaucuccacauugugggaagguaauccagggagguuuuggaacacuacuauugcagugucaauggcuaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacuaaagaauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucgucagugaacaugaucucaaggaugcugauuaacagauucacaaugaaacacaagaaagccaccuacgagccagauguugaccuagggagcggaacccgcaacauuggaauugagagugagaugccaaaucuagacauaauaggaaagagaauagagaaaauaaaacaagagcaugaaacaucauggcacuaugaccaggaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcguguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagcuuugggggccauauucacugaugagaacaaauggaagucggcacgcgaggcuguugaagauaguagguuuugggagcugguugacaaggaaagaaaucuccaucuugaagggaagugugaaacauguguguacaacaugaugggaaagagagaaaagaaacuaggggaguucggcaaggcaaaagguagcagagccauaugguacauguggcuuggagcacgcuucuuggaguuugaagccuugggauucuugaaugaggaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucggcaccuauggccuuaacacuuucaccaauauggaagcccaacuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuccaugaguuaaucaugaaagauggucgcgugcucguaguuccaugcagaaaccaagaugaacugaucggcagggcccgaauuucccagggagcuggguggucucugaaggagacggccuguuuggggaagucuuacgcucaaauguggagucugauguacuuccacagacgugaccucaggcuggcggcaaacgccauuugcucggcagucccgucacauuggguuccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugaucgggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 7022 - RNA, 9876 nt, Artificial Sequence
  derived and/or modified CDS sequence (wt) from DENV-2__FM210234__SS-prME
acagcaggcgugauuauuauguuaauuccaacagcgauggcguuccauuuaaccacacguaauggagaaccacacaugaucguuggcagacaagagaaagggaaaagucuucuguuuaaaacagaggauggugugaacauguguacccucauggccauugaucuuggugaauugugugaagauacaaucacguacaagugcccccuccucaggcagaaugaaccagaagauauagauuguuggugcaacuccacguccacauggguaacuuaugggacguguaccaccacaggagaacacagaagagaaaaaagaucaguggcacucguuccacauguggguaugggacuggagacgcgaacugaaacauggaugucgucagaaggggccuggaaacacgcucagagaauugaaaccuggauuuugagacauccaggcuuuaccauaauggcagcaauccuggcauacaccguaggaacgacacauuuccaaagggcccugauuuucaucuuacuggcagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccgacauuggauuuugaacugauaaaaacugaagccaaacaaccugccacucuaaggaaguacuguauagaggcaaagcugaccaauacaacaacagaaucucguugcccaacacaaggggaacccagucuaaaugaagagcaggacaaaagguucgucugcaaacacuccaugguagacagaggauggggaaauggauguggauuauuuggaaagggaggcauugugaccugugcuauguuuacaugcaaaaagaacauggaaggaaaaaucgugcaaccagaaaauuuggaauacaccaucgugauaacaccucacucaggagaagagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuagugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacaggaaaagauagcccagucaacauagaagcagaaccuccauucggagacagcuacaucauuauaggaguagagccgggacaauugaaacucaacugguucaagaaaggaaguuccaucggccaaauguuugagacaacaaugagaggagcaaagagaauggcuauuuuaggugauacagccugggauuuuggaucccugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguugugagcuggaaaaacaaagaacugaaauguggcagcgggaucuucaucacagauaacgugcauacguggacagaacaauacaaguuccagccagaauccccuucaaaauuagcuucagcuauccaaaaagcucaugaagaggguauuuguggaauccgcucaguaacaagguuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggcccugaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaaguuaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauugcacuauuccuggaagaaaugcucaggacacgaguaggaacgaaacaugcaauacugcuaguugcaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuuugcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauacugcaaaacgcauggaaggugagcugcacaauauuggcaacgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggaaguccaaguccuggcauuggaaccugggaaaaauccaagagcuguccaaacgaaaccuggacuuuucaaaaccaacaccggaaccauaggcgccguaucuuuggacuuuuccccuggaacgucaggaucuccaauugucgauagaaaaggaaaaguugugggucuuuauggcaaugguguugucacaaggaguggagcauacgugagugcuauagcccagaccgaaaaaagcauugaagacaauccagagauugaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacaccgggcgggagauuguggaucuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaagcagcugggaucuucaugacagccacuccuccgggaaguagagacccauuuccacagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggacaaaugauugggacuuuguggucacaaccgacauuucagaaaugggugccaacuucaaggcugagaggguuauagaccccagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucugguuggcuuacagaguggcagcugaaggcaucaacuaugcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccauuggcacuaaaagaauucaaggaauuugcggcuggaagaaaguccuugacccugaaccuaaucacagaaauggguagacuuccaacuuucaugacccagaaggcaagagacgcacuagauaaccuagcugugcugcauacggcugaagcagguggaagggcguacaaucaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuauggcaugcacagauacaaccacacuggauagcagcuucaauaauauuggaguuuuuucucauaguuuugcucauuccagagccagaaaaacagagaacaccccaagauaaccaacugaccuacguugucauagccauccucacagugguggccgcaaccauggcaaacgagauggguuucuuggaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuucaagcgaaagcaaccagagaagcucagaaaagagcagcagcaggcaucaugaaaaacccaacagucgauggaauaacagugauugaccuagauccaauacccuaugauccaaaauuugaaaaacagcuaggacaaguaaugcuccugauucucugcgugacucaaguauuaaugaugaggacuacaugggcuuugugugaggcucugaccuuagcgaccgggcccaucuccacauugugggaagguaauccagggagguuuuggaacacuacuauugcagugucaauggcuaacauuuuuagagggagcuacuuggcuggagcuggacuucuuuuuuccaucaugaagaacacaacaaauacaagaagaggaacuggcaacauaggagagacgcuuggagagaaauggaaaagccgauugaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacuaaagaauguaagagaagucaaaggccugacaaaaggaggaccaggacacgaagaaccaauccccaugucaacauauggguggaaucuaguacgccugcagaguggaguugauguuuuuuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucgucagugaacaugaucucaaggaugcugauuaacagauucacaaugaaacacaagaaagccaccuacgagccagauguugaccuagggagcggaacccgcaacauuggaauugagagugagauaccaaaucuagacauaauaggaaagagaauagagaaaauaaaacaagagcaugaaacaucauggcacuaugaccaggaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcguguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggggccauauucacugaugagaacaaauggaagucagcacgcgaggcuguugaagauaguagguuuugggagcugguugacaaggaaagaaaucuccaucuugaagggaaaugugaaacauguguguacaacaugaugggaaagagagaaaagaaacuaggggaguucgggaaggcaaaagguagcagagccauaugguacauguggcuuggagcacgcuuccuggaguuugaagccuugggauucuugaaugaagaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagauuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucggcaccuauggccuuaacacuuucaccaauauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggguggucccugaaggagacggccuguuuggggaagucuuacgcucaaauguggagucugauguacuuucacagacgugaccucaggcuggcggcaaacgccauuugcucggcagucccgucacauuggguuccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 7023 - RNA, 9876 nt, Artificial Sequence
  derived and/or modified CDS sequence (wt) from DENV-2__FM210213__SS-prME
acagcaggcgugauuauuauguuaauuccaacagcgauggcguuccauuuaaccacacgcaauggagaaccacacaugaucguuggcagacaagagaaagggaaaagucuucuguuuaaaacagaggauggugugaacaugugcacccucauggccauugaucuuggugaauugugugaagauacaaucacguacaagugcccccuccucaggcagaaugaaccagaagauauagauugcuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggauuuugagacauccaggcuuuaccauaauggcagcaauccuggcauacaccguaggaacgacacauuuccaaagggcccugauuuucaucuuacuggcagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacugaagccaaacaaccugccacucuaaggaaguacuguauagaggcaaagcugaccaauacaacaacagaaucucguugcccaacacaaggggaacccagucuaaaugaagaacaggacaaaagguucgucugcaaacacuccaugguagacagaggauggggaaauggauguggauuauuuggaaagggaggcauugugaccugugcuauguucacgugcaaaaagaacauggaaggaaaaaucgugcaaccagaaaauuuggaauacaccaucgugauaacaccucacucaggagaagagcacgcuguagguaaugacacagggaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuauucacaggacaucucaaauguaggcugagaauggacaaacuacagcucaaaggaaugucauacucuauguguacaggaaaguuuaaaaucgugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggccaaauguuugagacaacaaugagaggagcaaagagaauggcuauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucauuaguauuggugggagucauaacacuguacuugggagcuauggugcaggcugauagugguugcguugugagcuggaaaaacaaagaacugaaauguggcagcgggaucuucaucacagauaacgugcauacguggacagaacaauacaaguuccaaccagaauccccuucaaaauuagcuucagcuauccaaaaagcucaugaagaggguauuuguggaauccgcucaguaacaagauuggagaaucugauguggaaacagauaacaccagaauugaaucacauucuaucagaaaaugagguaaaguugaccauuaugacaggagacauuaaaggaaucaugcaggcaggaaaacgaucucugcggccccagccuacugagcugaaguauucauggaaaacauggggaaaggcgaaaaugcucuccacagaaucucacaaccagaccuuucucauugauggcccugaaacagcagaaugccccaacacaaacagagcuuggaacucgcuggaaguugaagacuaugguuuuggaguuuucaccaccaacauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaaguuaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucucuaagaacgaccacugccucuggaaaacucauaacagaauggugcugccgauccuguacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauggcacuauuccuggaagaaaugcucaggacacgaguaggaacgaaacaugcaauacugcuaguugcaguuucuuuugugacauuaauuacugggaacauguccuuuagagaucugggaagagugaugguuauggugggcgcugccaugacggaugacauagguaugggagugacuuaucuugcccuacuggcagcuuucaaaguaagaccaacuuuugcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcaacgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggauggucaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucaccuccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggaaguccaaguccuggcauuggaaccugggaaaaauccaagagcuguccaaacgaaaccuggacuuuucaaaaccaacaccggaaccauaggcgccguaucuuuggacuuuuccccuggaacgucaggaucuccaauugucgauagaaaaggaaaaguugugggucuauauggcaaugguguugucacaaggaguggagcauacgugagugcuauagcccagaccgaaaaaagcauugaagacaauccagaaaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcauaccgggcgggaaauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccggggaguagagacccauuuccucagagcaaugcaccaaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaacugacaucucagaaaugggugccaacuucaaggcugagaggguuauagaccccagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucugguuggcuuacagaguggcagcugaaggcaucaacuaugcagacagaaggugguguuuugauggaguuaagaacaaccaaauacuagaagaaaauguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagaaacgcacuagauaaccuagcugugcugcauacggcugaggcagguggaagggcguacaaucaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuauggcaugcacagauacaaccacacuggauagcagcuucaauaauauuggaguuuuuucucauaguuuugcucauuccagagccagaaaaacagagaacaccccaagauaaccaacugaccuacguugucauagccauccucacagugguggccgcaaccauggcaaacgagauggguuuccuggaaaaaaccaagaaagaccucggauugggaagcauugcaacccaggaaccugagagcaacauccuggacauagaucuacguccugcgucagcauggacacuguaugccguggcuacaacauuugucacaccaauguugagacauagcauugaaaacuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuucaagcgaaagcaaccagagaagcucagaaaagagcagcagcaggcaucaugaaaaauccaacagucgauggaauaacagugauugaccuagauccaauacccuaugauccaaaauuugaaaaacagcuaggacaaguaaugcuccugauucucugcgugacucaaguauuaaugaugaggacuacaugggcuuugugugaggcucuaaccuuagcgaccgggcccaucuccacauugugggaagguaauccagggagguuuuggaacacuacuauugcagugucaauggcuaacauuuuuagagggagcuacuuggcuggagcuggacuucuuuuuuccaucaugaagaacacaacaaacacaagaagaggaacuggcaacauaggagagacgcuuggagagaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacuaaagaauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggagagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucagugaacaugaucucaaggaugcugauuaacagauucacaaugaaacacaagaaagccaccuacgagccagauguugaccuagggagcggaacccgcaacauuggaauugaaagugagauaccaaaucuagacauaauaggaaagagaauagagaaaauaaaacaagagcaugagacaucauggcacuaugaccaagaccacccauacaaaacaugggcuuaccauggcagcuaugaaacaaaacagacuggaucagcaucauccauggugaauggaguggucagacugcugacaaaaccuugggacgucgucccuaugguaacacagauggcaaugacagacacgacuccauuuggacaacagcguguuuucaaagagaaaguggacacgagaacccaagaaccgaaggaaggcacaaagaaacugaugaaaaucacggcagaguggcuuuggaaagaacuaggaaagaaaaagacaccuaggauguguaccagagaagaauucacaagaaaaguaagaagcaaugcagccuugggggccauauucacugaugagaacaaauggaagucggcacgcgaggcuguugaagauaguagguuuugggagcugguugacaaggaaagaaaucuccaucuugaagggaagugugaaacauguguguacaacaugaugggaaagagagaaaagaaacuaggagaguucggcaaggcaaaggguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucggcaccuauggccuuaacacuuucaccaauauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugauaugggaaaagucaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggguggucucugaaggagacggccuguuuggggaagucuuacgcucaaauguggagucugauguacuuccacagacgugaccucaggcuggcggcaaaugcuauuugcucggcagucccgucacauuggguuccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 7024 - RNA, 9876 nt, Artificial Sequence
  derived and/or modified CDS sequence (wt) from DENV-2__FM210235__SS-prME
acagcaggcgugauuauuauguuaauuccaacagcgauggcguuccauuuaaccacacgaaauggagaaccacacaugaucguuggcagacaagagaaagggaaaagucuucuguuuaaaacagaggauggugugaacauguguacccucauggccauugaccuuggugaauugugugaagauacaaucacguacaagugcccccuccucaggcagaaugaaccagaagacauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggaucuugagacauccagguuuuaccauaauggcagcaauccuggcauacacuguaggaacgacacauuuccaaagggcccugauuuucaucuuauuggcagcugucgcuccuucaaugacaaugcguugcauaggaauaucaaauagagacuuuguagaagggguuucaggaggaagcuggguugacauagucuuagaacauggaaguugugugacgacaauggcaaaaaauaaaccaacacuggauuuugaacugauaaaaacagaagccaaacaaccugccacucuaaggaaguacuguauagaggcaaagcugaccaauacaacaacagaaucucguugcccaacacagggggaacccaguuuaaaugaagagcaggacaaaagguucgucugcagacacuccaugguagacagaggauggggaaauggauguggauuauuuggaaagggaggcauugugaccugugcuauguucacaugcaaaaagaacauggaaggaaaaaucgugcaaccagaaaauuuggaauacaccaucgugauaacaccucacucaggagaagagcacgcuguagguaaugacacaggaaaacaugguaaggaaauuaaaauaacaccacaaagucccaucacagaagcagaacugacaggcuauggcacagucacgauggagugcucuccgagaacgggccuugacuucaaugagauggugcugcugcagauggaggauaaagcuuggcuggugcacaggcaaugguuccuagaccugccguuaccauggcuacccggagcggacacacaaggaucaaauuggauacagaaagagacauuggucacuuucaaaaauccccacgcgaagaagcaggaugucguuguuuuaggaucgcaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggacaaauguuugagacaacaaugagaggagcaaagagaauggccauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguugugagcuggaaaaacaaagaacugaaauguggcagcgggaucuucaucacagauaacgugcacacguggacagaacaauacaaguuccaaccagaauccccuucaaaauuagcuucagccauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuagaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacacuaccaccucuaagauacaggggugaggauggaugcugguaugggauggaaaucagaccauuaaaagagaaagaagagaauuuggucaacuccuuggucacagccggacaugggcagauugacaacuuuucacuaggagucuugggaauggcauuauuccuggaagaaaugcucaggacacgaguaggaacgaaacaugcaauacugcuaguuacaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuucgcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccacugcucuuaacauccucacagcagaaagcggauuggauaccacuggaauggucgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguggcuggagggcuccuuacuguguguuacgugcucacuggacgaucggccgauuuagaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccuaugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaagaauccaagagcuguccaaacgaaaccuggacuuuucaaaaccaacaccggaaccauaggcgccguaucuuuggacuuuuccccuggaacaucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagaguuguggcagcugaaauggaggaagcccuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggcgccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguugaugccauugauggugaauaccgcuugagaggagaagcaaggaagaccuuuguggaccuaaugagaagaggggacuuaccagucugguuggcuuacagaguggcagcugaaggcaucaacuacgcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuggauaaccuagcugugcugcauacggcugaggcagguggaagggcguacaaucaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuaugguaugcacagauacaaccacacuggauagcagcuucaauaauauuggaguuuuuucucauaguuuugcucauuccagaaccagaaaaacagagaacaccccaagauaaccaacugaccuacguuguuauagccauccuuacagugguggccgcaaccauggcaaacgagauggguuuccuagaaaaaaccaagaaagaccucggauugggaagcauugcaacccgggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuccaagcgaaagcaaccagagaagcucagaaaagagcagcagcaggcaucaugaaaaacccaacagucgauggaguaacagugauugaccuagauccaauacccuaugauccaaaauuugaaaaacagcuaggacaaguaaugcuccugauucucugcgugacucaaguacuaaugaugaggacuacaugggcuuugugugaggcucuaaccuuagcgaccgggcccaucuccacauugugggaagguaauccagggagauuuuggaacacuacuauugcagugucaauggcuaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacuggggaaaagugaauuucagaucuacaagaaaaguggaauccaggaaguggauagaaccuuagcaaaagaaggcaucaaaagaggagaaacggaccaccacgcugugucgcgagguucagcaaaacugagaugguucgucgagagaaauauggucacaccagaagggaaagugguggaccuugguugcggcagagggggcuggucauacuauugugggggacuaaagaauguaagagaagucaaaggccugacaaaaggaggaccaggacacgaggaaccuauccccaugucaacauauggguggaaucuaguacgucugcagaguggaguugaugucuucuucacuccgccagaaaagugugacacacuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugccacugggaacauagugucaucagugaacaugauuucaaggaugcugauuaacagauucacaaugaaacacaagaaagccaccuacgagccagauguugauuuagggagcggaacccgcaacauuggaauugaaagugagauaccaaaucuagacauaauaggaaagagaauagagaaaauaaagcaagagcaugaaacaucauggcacuaugaccaagaccacccauauaaaacaugggcuuaccauggcagcuaugaaacaaaacagacuggaucagcaucauccauggugaacggaguggucagacuacugacaaaaccuugggacgucgucccuaugguaacacagauggcaaugacagauacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaggugagaagcaaugcagccuugggggccauauucacugaugagaacaaauggaagucggcacgcgaggcuguugaagauagcagguuuugggagcugguugacaaggaaagaaaucuccaucuugaagggaagugugaaacauguguguacaacaugaugggaaagagagaaaagaaacuaggggaguucgguaaggcaaaggguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaaggaaggaggagcgauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucgguaccuauggccucaacacuuucaccaauauggaagcccaauuaauuagacagauggagggagaaggaguuuucaaaagcauucagcgccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggguggucuuugaaggagacggccuguuuggggaaguccuacgcucaaauguggagucugauguacuuccacagacgugaccucaggcuggcggcaaaugcuauuugcucggcagucccgucacauugggucccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaaugguguggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 7025 - RNA, 9876 nt, Artificial Sequence
  derived and/or modified CDS sequence (wt) from DENV-2__FM210205__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcuaagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacauccauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugugacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugaaaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuucuccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccgagagccguccaaacaaaaccuggucuuuucaaaaccaacaccggaacaauaggugccguaucucuggacuuuuccccuggaacgucaggaucuccaaucaucgacaaaaaaggaaaaguugugggucuuuauggcaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcagagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcguuaaaagaguucaaagaauuugcagccggaagaaagucucugacccugaaccuaauuacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggauuuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccauggcagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaauugaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaaaaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucgugugcuuguuguuccauguagaaaccaagaugaacugauuggcagagcccgaaucucccaaggagcaggguggucuuugcgggagacggccugcuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 7026 - RNA, 9876 nt, Artificial Sequence
  derived and/or modified CDS sequence (wt) from DENV-2__FM210206__SS-prME
ucugcagguaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucacccuaauggcagcaauccuggcauacaccauagggacgacacauuuccagagagucuugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacaaaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagacagcccagucaacauagaagcagaaccuccauucggagacagcuacaucauuauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaaucgugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucgaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccauagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacauacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuucgauuucugcgauggaacuacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaagucagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagcuaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuauuauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccaguaacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaauauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacagcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgcccugcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcacuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcgaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaccuggugcgucuccagaguggaguugacgucuucuucaucccgccagaaaagugugacacauuguugugugacauaggggagucaucgccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgcaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgcuaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 7027 - RNA, 9876 nt, Artificial Sequence
  derived and/or modified CDS sequence (wt) from DENV-2__FM210246__SS-prME
ucugcagguaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggccauggaccuuggugaauugugugaagacacaaucacguacaaguguccucuucucaggcagaaugagccagaagacauagacuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagccuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagccucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuuuaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaucugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgagguuugagaacauuaauccuggcccccacuagaguuguggcagcugaaauggaggaagcucucagaggacuuccaauaagauaccaaaccccagccaucagagcugagcacacugggcgggagauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagcaaaaaugcuccuagauaacaucaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaaaaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccagagacuuuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauagucuugcuuauuccagaaccagaaaaacagagaacaccccaagacaaccaacugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccgcucucacggaacuccacgcaugagauguacuggguauccaaugcuucugggaacauagugucaucagugaacaugauuucaaggauguugaucaauagauucacaaugagacacaagaaagccacuuacgagccggauguugaccucggaagcggaacccgcaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggaguugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcccgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugaaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 7028 - RNA, 9876 nt, Artificial Sequence
  derived and/or modified CDS sequence (wt) from DENV-2__FM210207__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacauggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacuguggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcugggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaaaggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcagcccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugcuguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaauugccggagacccuagagacacugcuuuuacugacacuucuggccacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagccacagggcccaucuccacacugugggaaggaaauccaggaagguucuggaacacuaccauugcggugucaauggcuaacaucuucagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaaaugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguauauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggaacaguaauggacaucauaucgagaagagaccagagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcucugacagcccuaaaugacaugggaaagauuagaaaagauauacaacagugggaaccuucaaaaggauggaacgauuggacacaagugcccuucuguucacaccauuuccaugagcuaauuaugaaggauggucguguacuuguuguuccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucagcagugccaucacacuggguuccaacaagucgaacaaccugguccaugcacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcggcaauaaaucagguuagaucucuuauaggcaaugaggaauacacagauuacaugccauccaugaaaagauucagaagagaagaggaagaagcaggaguccugugguaa

SEQ ID NO: 7029 - RNA, 9876 nt, Artificial Sequence
  derived and/or modified CDS sequence (wt) from DENV-2__FM210238__SS-prME
acggcaggcaugaucauuauguuaauuccaacagcgauggcguuccauuuaaccacacgaaauggagaaccacacaugaucguuggcagacaagagaaagggaaaagucuucuguuuaaaacagaggauggugugaacauguguacccucauggccauugaucuuggugaauugugugaagauacaaucacguacaagugcccccuccucaggcagaaugaaccagaagacauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggaucuugagacauccaggcuuuaccauaauggcagcaauccuggcauacaccguaggaacgacacauuuccaaagggcccugauuuucaucuuacuggcagcugucgcuccuucaaugacaaugcguugcauaggaauaucaaauagagacuuuguagaagggguuucaggaggaagcuggguugacauagucuuagaacauggaaguugugugacgacaauggcaaaaaauaaaccaacacuggauuuugaacugauaaaaacagaagccaaacaaccugccacucuaaggaaguacuguauagaggcaaagcugaccaauacaacaacagaaucucguugcccaacacaaggggaacccagucuaaaugaagagcaggacaaaagguucgucugcaaacacuccaugguagacagaggauggggaaauggauguggauuauuuggaaagggaggcauugugaccugugcuauguucacaugcaaaaagaacauggaaggaaaaaucgugcaaccagaaaauuuggaauacaccaucgugauaacaccucacucaggagaagagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaagaauccccacgcgaagaagcaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggccaaauguuugagacaacaaugagaggagcaaagagaauggccauuuuaggugacacagccugggauuuuggaucucugggaggaguguuuacaucuauaggaaaggcucuccaccaaguuuucggagcaaucuauggggcugccuucagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguugugagcuggaaaaacaaagaacugaaauguggcagcgggaucuucaucacagauaacgugcacacguggacagaacaauacaaguuccaaccagaauccccuucaaaauuagcuucagccauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauggcacuauuccuggaagaaaugcucaggacacgaguaggaacgaaacaugcaauacugcuaguuacaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuucgcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaagaauccaagagcuguccaaacgaaaccuggacuuuucaaaaccaacaccggaaccauaggcgccguaucuuuagacuuuuccccuggaacgucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaggcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucugguuggcuuacagaguggcagcugaaggcaucaacuacgcagacagaaggugguguuuugauggaguuaagaacgaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuggauaaccuagcugugcugcauacggcugaggcagguggaagggcguacaaucaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuaugguaugcacagauacaaccacacuggauagcagcuucaauaauauuggaguuuuuucucauaguuuugcucauuccagaaccagaaaaacagagaacaccccaagauaaccaacugaccuacguuguuauagccauccucacagugguggccgcaaccauggcaaacgagauggguuuccuggaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuccaagcgaaagcaaccagagaagcucagaaaagagcagcagcaggcaucaugaaaaacccaacagucgauggaauaacagugauugaccuagauccaauacccuaugauccaaaauuugaaaaacagcuaggacaaguaaugcuccugauucucugcgugacucaaguacuaaugaugaggacuacaugggcuuugugugaggcucuaaccuuagcgaccgggcccaucuccacauugugggaagguaauccagggagguuuuggaacaccacuauugcagugucaauggcuaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccuugguugcggcagagggggcuggucauacuauugugggggacuaaagaauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucagugaacaugaucucaaggaugcugauuaacagauucacaaugaaacacaagaaagccaccuacgagccagauguugacuuagggagcggaacccgcaacauuggaauugaaagugagauaccaaaucuagacauaauaggaaagagaauagagaaaauaaaacaagagcaugaaacaucauggcacuaugaccaagaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggggccauauucacugaugagaacaaauggaagucggcacgcgaggcuguugaagauagcagguuuugggagcugguugacaaggaaagaaaucuccaucuugaagggaagugugaaacauguguguacaacaugaugggaaagagagaaaagaaacuaggggaguucggcaaggcaaaagguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucggcaccuauggccucaacacuuucaccaauauggaagcccaauuaauuagacagauggagggagaaggaguuuucaaaagcauucagcgccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggguggucuuugaaggagacggccuguuuggggaagucuuacgcucaaauguggagucugauguacuuccacagacgugaccucaggcuggcggcaaaugcuauuugcucggcagucccgucacauugggucccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 7030 - RNA, 9876 nt, Artificial Sequence
  derived and/or modified CDS sequence (wt) from DENV-2__FM210224__SS-prME
acagcaggcgugauuauuauguugauuccaacagcgauggcguuccaucuaaccacacguaauggagaaccacacaugaucguugguagacaagagaaagggaaaagucuucuguucaaaacggaggauggugugaacauguguacccucauggccauagaucuuggugaauugugugaagauacaaucacguacaagugcccccuccucaggcagaaugaaccagaagacauagauuguugguguaacuccacguccacauggguaacuuaugggacgugcaccaccacaggagaacacagaagagaaaaaagaucaguggcacucguuccacauguggguaugggacuggagacacgaacugaaacauggaugucgucagaaggagccuggaaacacgcucagagaauugaaaccuggaucuugagacauccaggcuuuaccauaauggcagcaauccuggcauacaccauaggaacgacacauuuccaaagggcccugauuuucaucuuacugacagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacagaagccaaacaaccugccacuuuaaggaaguacuguauagaagcaaagcugaccaacacaacaacagaaucucguugcccaacacaaggggaacccagucuaaaugaagagcaggacaaaagguucgucugcaaacacuccaugguggacagaggauggggaaauggauguggauuauuuggaaagggaggcaucgugaccugugcuauguuuacaugcaaaaagaacauggaaggaaaaaucgugcagccagaaaauuuggaauacaccaucgugauaacaccucacucaggagaagagcaugcuguagguaaugacacaggaaaacaugguaaggaaaucaaaauaacaccacagaguuccaucacagaagcagaacugacaggcuauggcacaguuacgauggagugcucuccgagaacgggccuugacuuuaaugagauggugcugcugcagauggaagacaaagcuuggcuggugcacaggcagugguuccuagaccugccguuaccauggcuacccggagcggacacacaaggaucaaauuggauacagaaagagacacuggucacuuucaaaaauccccacgcgaagaaacaggaugucguuguuuuaggaucucaagaaggggccaugcacacggcacucacaggggccacagaaauccagaugucaucaggaaacuuacuauucacaggacaucucaagugcaggcugagaauggacaaacuacagcucaaaggaaugucauacucuaugugcacaggaaaguucaaaauugugaaggaaauagcagaaacacaacauggaacaauaguuauuagaguacaauaugaaggagacggcucuccauguaagaucccuuuugaaauaauggauuuagaaaaaagacaugucuuaggucgccugauuacaguuaacccgaucguaacagaaaaagauagcccagucaacauagaagcagaaccuccauucggagacagcuacaucauuauaggaguagagccgggacaauugaaacucaacugguuuaagaaaggaaguuccauuggccaaauguuugagacaacaaugagaggagcgaagaggauggccauuuuaggugacacagccugggauuuuggaucccuaggaggaguguuuacaucuauaggaaaagcucuccaccaaguuuucggagcaaucuauggggcugccuuuaguggggucucauggacuaugaaaauccucauaggagccaucaucacauggauaggaaugaauucacguagcaccucacugucugugucacuaguauuggugggagucauaacacuguacuugggagccauggugcaggcugauagugguugcguugugagcuggaaaaacaaagaacugaaauguggcagcgggaucuucaucacagauaacgugcacacauggacagaacaauacaaguuccaaccagaauccccuucaaaauuagcuucagcuauccagaaagcucaugaagagggcauuugugggauucgcucaguaacaagauuggagaaucugauguggaaacaaauaacaccagaauugaaccacauucuaucagaaaaugagguaaaguugaccaucaugacaggagauauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuauggcuuuggaguuuucaccaccaacauauggcuaaaauugagagaaaaacaggauguguuuugugacucaaaacucaugucagcagccauaaaagacaacagagccguccaugccgauauggguuacuggauagaaagugcacucaaugacacauggaagauggaaaaggccuccuucauugaaguuaaaagcugccacuggccaaagucacacacccucuggagcaauggaguauuagaaagugagaugauaauuccaaaaaguuuugcugggccagugucacaacacaacuacagaccaggcuauuacacgcaaacagcaggaccuuggcaucuagguaagcuugaaauggacuuugauuucugcgaaggaacuacagugguggugacugaggacugcggaaauagaggacccucuuuaagaacgaccacugccucuggaaaacuuauaacagaauggugcugccgauccugcacauuaccaccucuaagauacagaggugaggauggaugcugguaugggauggaaaucagaccauuaaaagagaaagaagagaauuuggucaacuccuuggucacagcaggacaugggcagauugacaacuucucacuaggagucuugggaauggcacuauucuuggaagaaaugcucaggacacgaguaggaacgaaacaugcaauacugcuaguugcaguuuccuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacuacugagaaagcugaccuccaaggaauuaaugauggcuaccauaggaauugcacuccuuucucaaagcaccauaccagagaccauucuugaacuaacugaugcguuagccuugggcaugaugguccuuaaaauagugagaaauauggaaaaguaccaauuggcagugacuaucauggcuaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaggcuaucauggcugucgggauggugagcauuuuagccaguucccucuuaaagaaugacauucccaugacagguccauuaguggcuggagggcuccuuacugugugcuacgugcucacuggacgaucggccgauuuggaacuggagagagccaccgaugucaaaugggaagaucaggcagaaauaucaggaagcagcccaauccugucaauaacaauaucagaagauggcagcaugucgauaaagaaugaagaggaagaacaaacacugaccauacucaucagaacgggauugcuagugaucucaggacucuuuccagugucaauaccaauuacggcagcagcaugguaccugugggaagugaagaaacaacgggcuggaguauugugggacgucccuucacccccacccgugggaaaggcugaacuggaagauggagccuauagaaucaagcagaaagggauucuuggauacucccagauuggagccggaguuuacaaagaaggaacauuccauacaauguggcacgucacacguggcgcuguucugaugcauagagggaagaggauugaaccaucaugggcggacgucaagaaagaccuaauaucauauggaggaggcuggaaacucgaaggagaauggaaggaaggagaggaaguccaaguccuggcauuggaaccuggaaaaaauccaagagcuguccaaacgaaaccuggacuuuucaaaaccaacaccggaaccauaggcgccguaucucuggacuuuucuccuggaacgucaggaucuccaauugucgacagaaaaggaaaaguugugggucuuuauggcaaugguguugucacaaggaguggagcauacgugagugcuauagcccagaccgaaaaaagcauugaagacaauccagagauugaagaugacauuuuccgaaagaaaagauugacuaucauggaccuccauccaggagcgggaaagacaaaaagauaccuuccagccauaguuagagaggccauaaaacguggcuuaagaacauuaauccuggcccccacuagagucguggcagcugaaauggaggaagcucuuagaggacuuccaauaagauaccaaaccccagccaucagagccgagcauaccgggcgggagauuguggaccuaaugugucaugccacguuuacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccgggaaguagagacccauuuccucagagcaaugcaccaaucauagaugaggaaagagaaaucccugagcgcucguggaacucuggacaugaaugggucacggauuuuaaagggaagacuguuugguuuguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacguugcaugaaaccaguuauacuaacagauggugaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcgcauuggaaagaagcuaaaaugcuccuagauaacaucaacacaccugaaggaaucauuccuaguauguucgaaccagagcgugaaaagguggaugccauugauggugaauaccgcuugagaggagaagcaaggaaaaccuuuguggaccuaaugagaagaggggacuuaccagucuggcuggccuacagaguggcagcugaaggcaucaacuacgcagacagaaggugguguuuugauggagcuaagaauaaccaaauacuggaagaaaacguggaaguggaaauuuggacaaaagagggggaaaggaagaaauuaaaacccagaugguuggacgcuaggaucuauucugacccacuggcacuaaaagaauucaaggaauuugcagcuggaagaaagucccuaacccugaaccuaaucacagaaauggguaggcuuccaacuuucaugacucaaaaagcaagagacgcacuggauaaccuagcugugcugcauacggcugaggcagguggaagagcguacaaucaugcucucagugaacugccggagacccuggagacacugcuuuuacugacacuucuggcuacagucacgggaggaaucuucuuauucuuaaugagcggaaaagguguagggaagaugacccugggaaugugcugcauaaucacggcuagcauccuccuaugguaugcacagauacaaccacacuggauagccgcuucaauaauauuggaguuuuuucucauaguuuugcucauuccagaaccagaaaaacagagaacaccccaagauaaccaauugaccuacguugucauagccauccucacaguaguggccgcaaccauggcaaacgaaauggguuuucuggaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuccuugccauuggauguuacucacaagucaaccccauaacucucacagcagcucuucuuuuauugauagcacauuaugccauuauagggccaggacuucaagcgaaagcaaccagagaagcucagaaaagagcagcagcaggcaucaugaaaaacccaacagucgauggaauaacagugaucgaccuagauccaauacccuaugauccaaaauuugaaaaacaguugggacaaguaaugcuccuaauucucugcgugacucaaguauuaaugaugaggacuacaugggcucugugugaggcucuaaccuuagcgaccgggcccaucuccacauugugggaaggcaauccagggagguuuuggaacacuaccauugcagugucaauggcuaacauuuuuagagggagcuacuuggcuggagcuggacuucuuuuuuccaucaugaagaauacaacaaauacaagaagaggaacuggcaacauaggagagacgcuuggagagaaauggaaaagccgauugaacgcacugggaaaaagugaauuucagauuuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacuaaagaauguaagagaagucaaaggccugacaaaaggaggaccaggacacgaggaaccuauccccaugucaacauauggguggaaucuaguacgucugcagaguggaguugauguuuucuucacuccgccagaaaagugugacacacuguugugugacauaggggagucgucaccaaaucccacgauagaagcaggacgaacacucagaguccucagcuugguggaaaauugguugaacaaugacacucaauuuugcauaaagguucucaacccauacaugcccucaguuauagaaaaaauggaaacacugcagaggaaauauggaggagccuuagugaggaauccacucucacgaaacuccacacaugagauguacuggguauccaaugcuacugggaacauagugucaucagugaacaugauuucaaggaugcugauuaacagauucacaaugaaacacaagaaagcuaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauauaaaacaugggcuuaccauggcagcuaugaaacaaaacagacuggaucagcaucauccauggugaacggaguggucagacuacugacaaaaccuugggacgucgucccuaugguaacacagauggcaaugacagauacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggggccauauucacugaugagaacaaauggaagucggcacgcgaggcuguugaagauaguagguuuugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuucuuggaguuugaagcccugggauucuugaaugaagaucacugguucucuagagagaacucccugaguggaguggaaggagaagggcugcacaagcuaggcuacauucuaagagacgugagcaagaaggaaggaggagcaauguacgccgaugauacagcaggaugggacacaagaaucacacuagaggacuuaaaaaaugaagaaauggugacaaaccacauggaaggagaacacaagagacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaauuuucaaaagcauucagcaccugacaguuacagaagaaaucgcuguacagaacugguuggcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucaaaaggauggaacgauuggacacaagugccuuuuuguucacaccauuuucaugaguuaaucaugaaagacggccgcgugcuugugguuccaugcagaaaccaagaugaacugauuggcagggcccgaauuucccagggagcuggguggucuuugaaggagacggccuguuuggggaagucuuacgcccaaauguggagccugauguacuuccacagacgugaccucaggcuggcggcaaaugcuauuugcucggcagucccgucacauuggguuccuacaagucgaacaaccuggucuauacacgccaaacaugaauggaugacgacggaagacaugcugacagucuggaacaggguguggauccaagaaaacccauggauggaagacaaaacuccaguggagucaugggaggaagucccauauuugggaaaaagagaagaccaauggugcggcucauugauugggcuaacaagcagggcuaccugggcaaagaauauccaaacagcaauaaaucaagucagaucccuuauaggcaaugaagaauacacagauuacaugccauccaugaagagauucagaagggaagaggaagaggcagguguccugugguag

SEQ ID NO: 7031 - RNA, 9876 nt, Artificial Sequence
  derived and/or modified CDS sequence (wt) from DENV-2__FM210225__SS-prME
acagcaggcgugauuauuauguugauuccaacagcgauggcguuccaucuaaccacacguaauggagaaccacacaugaucguugguagacaagagaaagggaaaagucuucuguucaaaacggaggauggugugaacauguguacccucauggccauagaucuuggugaauugugugaagauacaaucacguacaagugcccccuccucaggcagaaugaaccagaagacauagauuguugguguaacuccacguccacauggguaacuuaugggacgugcaccaccacaggagaacacagaagagaaaaaagaucaguggcacucguuccacauguggguaugggacuggagacacgaacugaaacauggaugucgucagaaggagccuggaaacacgcucagagaauugaaaccuggaucuugagacauccaggcuuuaccauaauggcagcaauccuggcauacaccauaggaacgacacauuuccaaagggcccugauuuucaucuuacugacagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacagaagccaaacaaccugccacuuuaaggaaguacuguauagaagcaaagcugaccaacacaacaacagaaucucguugcccaacacaaggggaacccagucuaaaugaagagcaggacaaaagguucgucugcaaacacuccaugguggacagaggauggggaaauggauguggauuauuuggaaagggaggcaucgugaccugugcuauguuuacaugcaaaaagaacauggaaggaaaaaucgugcagccagaaaauuuggaauacaccaucgugauaacaccucacucaggagaagagcaugcuguagguaaugacacaggaaaacaugguaaggaaaucaaaauaacaccacagaguuccaucacagaagcagaacugacaggcuauggcacaguuacgauggagugcucuccgagaacgggccuugacuucaaugagauggugcugcugcagauggaagacaaagcuuggcuggugcacaggcagugguuccuagaccugccguuaccauggcuacccggagcggacacacaaggaucaaauuggauacagaaagagacacuggucacuuucaaaaauccccacgcgaagaaacaggaugucguuguuuuaggaucucaagaaggggccaugcacacggcacucacaggggccacagagauccagaugucaucaggaaacuuacuauucacaggacaucucaagugcaggcugagaauggacaaacuacagcucaaaggaaugucauacucuaugugcacaggaaaguucaaaauugugaaggaaauagcagaaacacaacauggaacaauaguuauuagaguacaauaugaaggagacggcucuccauguaagaucccuuuugaaauaauggauuuagaaaaaagacaugucuuaggucgccugauuacaguuaacccgaucguaacagaaaaagauagcccagucaacauagaagcagaaccuccauucggagacagcuacaucauuauaggaguagagccgggacaauugaaacucaacugguuuaagaaaggaaguuccauuggccaaauguuugagacaacaaugagaggagcgaagaggauggccauuuuaggugacacagccugggauuuuggaucccuaggaggaguguuuacaucuauaggaaaagcucuccaccaaguuuucggagcaaucuauggggcugccuuuaguggggucucauggacuaugaaaauccucauaggagccaucaucacauggauaggaaugaauucacguagcaccucacugucugugucacuaguauuggugggagucauaacacuguacuugggagccauggugcaggcugauagugguugcguugugagcuggaaaaacaaagaacugaaauguggcagcgggaucuucaucacagauaacgugcacacauggacagaacaauacaaguuccaaccagaauccccuucaaaauuagcuucagcuauccagaaagcucaugaagagggcauuugugggauucgcucaguaacaagauuggagaaucugauguggaaacaaauaacaccagaauugaaccacauucuaucagaaaaugagguaaaguugaccaucaugacaggagauauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuauggcuuuggaguuuucaccaccaacauauggcuaaaauugagagaaaaacaggauguguuuugugacucaaaacucaugucagcagccauaaaagacaacagagccguccaugccgauauggguuacuggauagaaagugcacucaaugacacauggaagauggaaaaggccuccuucauugaaguuaaaagcugccacuggccaaagucacacacccucuggagcaauggaguauuagaaagugagaugauaauuccaaaaaguuuugcugggccagugucacaacacaacuacagaccaggcuauuacacgcaaacagcaggaccuuggcaucuagguaagcuugaaauggacuuugauuucugcgaaggaacuacagugguggugacugaggacugcggaaauagaggacccucuuuaagaacgaccacugccucuggaaaacuuauaacagaauggugcugccgauccugcacauuaccaccucuaagauacagaggugaggauggaugcugguaugggauggaaaucagaccauuaaaagagaaagaagagaauuuggucaacuccuuggucacagcaggacaugggcagauugacaacuucucacuaggagucuugggaauggcacuauucuuggaagaaaugcucaggacacgaguaggaacgaaacaugcaauacugcuaguugcaguuuccuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacuacugagaaagcugaccuccaaggaauuaaugauggcuaccauaggaauugcacuccuuucucaaagcaccauaccagagaccauucuugaacuaacugaugcguuagccuugggcaugaugguccuuaaaauagugagaaauauggaaaaguaccaauuggcagugacuaucauggcuaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaggcuaucauggcugucgggauggugagcauuuuagccaguucccucuuaaagaaugacauucccaugacagguccauuaguggcuggagggcuccuuacugugugcuacgugcucacuggacgaucggccgauuuggaacuggagagagccaccgaugucaaaugggaagaucaggcagaaauaucaggaagcagcccaauccugucaauaacaauaucagaagauggcagcaugucgauaaagaaugaagaggaagaacaaacacugaccauacucaucagaacgggauugcuagugaucucaggacucuuuccagugucaauaccaauuacggcagcagcaugguaccugugggaagugaagaaacaacgggcuggaguauugugggacgucccuucacccccacccgugggaaaggcugaacuggaagauggagccuauagaaucaagcagaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaaacucgaaggagaauggaaggaaggagaggaaguccaaguccuggcauuggaaccuggaaaaaauccaagagcuguccaaacgaaaccuggacuuuucaaaaccaacaccggaaccauaggcgccguaucucuggacuuuucuccuggaacgucaggaucuccaauugucgacagaaaaggaaaaguugugggucuuuauggcaaugguguugucacaaggaguggagcauacgugagugcuauagcccagaccgaaaaaagcauugaagacaauccagagauugaagaugacauuuuccgaaagaaaagauugacuaucauggaccuccauccaggagcgggaaagacaaaaagauaccuuccagccauaguuagagaggccauaaaacguggcuuaagaacauuaauccuggcccccacuagagucguggcagcugaaauggaggaagcucuuagaggacuuccaauaagauaccaaaccccagccaucagagccgagcauaccgggcgggagauuguggaccuaaugugucaugccacguuuacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccgggaaguagagacccauuuccucagagcaaugcaccaaucauagaugaggaaagagaaaucccugagcgcucguggaacucuggacaugaaugggucacggauuuuaaagggaagacuguuugguuuguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacguugcaugaaaccaguuauacuaacagauggugaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcgcauuggaaagaagcuaaaaugcuccuagauaacaucaacacaccugaaggaaucauuccuaguauguucgaaccagagcgugaaaagguggaugccauugauggugaauaccgcuugagaggagaagcaaggaaaaccuuuguggaccuaaugagaagaggggacuuaccagucuggcuggccuacagaguggcagcugaaggcaucaacuacgcagacagaaggugguguuuugauggaguuaagaauaaccaaauacuggaagaaaacguggaaguggaaauuuggacaaaagagggggaaaggaagaaauuaaaacccagaugguuggacgcuaggaucuauucugacccacuggcacuaaaagaauucaaggaauuugcagcuggaagaaagucccuaacccugaaccuaaucacagaaauggguaggcuuccaacuuucaugacucaaaaagcaagagacgcacuggauaaccuagcugugcugcauacggcugaggcagguggaagagcguacaaucaugcucucagugaacugccggagacccuggagacacugcuuuuacugacacuucuggcuacagucacgggaggaaucuucuuauucuuaaugagcggaaaagguguagggaagaugacccugggaaugugcugcauaaucacggcuagcauccuccuaugguaugcacagauacaaccacacuggauagccgcuucaauaauauuggaguuuuuucucauaguuuugcucauuccagaaccagaaaaacagagaacaccccaagauaaccaauugaccuacguugucauagccauccucacaguaguggccgcaaccauggcaaacgaaauggguuuucuggaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuccuugccauuggauguuacucacaagucaaccccauaacucucacagcagcucuucuuuuauugauagcacauuaugccauuauagggccaggacuucaagcgaaagcaaccagagaagcucagaaaagagcagcagcaggcaucaugaaaaacccaacagucgauggaauaacagugaucgaccuagauccaauacccuaugauccaaaauuugaaaaacaguugggacaaguaaugcuccuaauucucugcgugacucaaguauuaaugaugaggacuacaugggcucugugugaggcucuaaccuuagcgaccgggcccaucuccacauugugggaaggcaauccagggagguuuuggaacacuaccauugcagugucaauggcuaacauuuuuagagggagcuacuuggcuggagcuggacuucuuuuuuccaucaugaagaauacaacaaauacaagaagaggaacuggcaacauaggagagacgcuuggagagaaauggaaaagccgauugaacgcacugggaaaaagugaauuucagauuuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacuaaagaauguaagagaagucaaaggccugacaaaaggaggaccaggacacgaggaaccuauccccaugucaacauauggguggaaucuaguacgucugcagaguggaguugauguuuucuucacuccgccagaaaagugugacacacuguugugugacauaggggagucgucaccaaaucccacgauagaagcaggacgaacacucagaguccucagcuugguggaaaauugguugaacaaugacacucaauuuugcauaaagguucucaacccauacaugcccucaguuauagaaaaaauggaaacacugcagaggaaauauggaggagccuuagugaggaauccacucucacgaaacuccacacaugagauguacuggguauccaaugcuacugggaacauagugucaucagugaacaugauuucaaggaugcugauuaacagauucacaaugaaacacaagaaagcuaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauauaaaacaugggcuuaccauggcagcuaugaaacaaaacagacuggaucagcaucauccauggugaacggaguggucagacuacugacaaaaccuugggacgucgucccuaugguaacacagauggcaaugacagauacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggggccauauucacugaugagaacaaauggaagucggcacgcgaggcuguugaggauaguagguuuugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuucuuggaguuugaagcccugggauucuugaaugaagaucacugguucucuagagagaacucccugaguggaguggaaggagaagggcugcacaagcuaggcuacauucuaagagacgugagcaagaaggaaggaggagcaauguacgccgaugauacagcaggaugggacacaagaaucacacuagaggacuuaaaaaaugaagaaauggugacaaaccacauggaaggagaacacaagagacuagccgaggccauauuuaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaauuuucaaaagcauucagcaccugacaguuacagaagaaaucgcuguacagaacugguuggcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucaaaaggauggaacgauuggacacaagugccuuuuuguucacaccauuuucaugaguuaaucaugaaagacggccgcgugcuugugguuccaugcagaaaccaagaugaacugauuggcagggcccgaauuucccagggagcuggguggucuuugaaggagacggccuguuuggggaagucuuacgcccaaauguggagccugauguacuuccacagacgugaccucaggcuggcggcaaaugcuauuugcucggcagucccgucacauuggguuccuacaagucgaacaaccuggucuauacacgccaaacaugaauggaugacgacggaagacaugcugacagucuggaacaggguguggauccaagaaaacccauggauggaagacaaaacuccaguggagucaugggaggaagucccauauuugggaaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 7032 - RNA, 9876 nt, Artificial Sequence
  derived and/or modified CDS sequence (wt) from DENV-2__FM210226__SS-prME
acagcaggcgugauuauuauguuaauuccaacagcgauggcguuccauuuaaccacacguaauggagaaccacacaugaucguuggcagacaagagaaagggaaaagucuucuguuuaaaacagaggauggugugaacauguguacccucauggccauugaucuuggugaauugugugaagauacaaucacguacaagugcccccuccucaggcagaaugaaccagaagauauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggauuuugagacauccaggcuuuaccauaauggcagcaauccuggcauacaccguaggaacgacacauuuccaaagggcccugauuuucaucuuacuggcagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacugaagccaaacaaccugccacucuaaggaaguacuguauagaggcaaagcugaccaauacaacaacagaaucucguugcccaacacaaggggaacccagucuaaaugaagagcaggacaaaagguucgucugcaaacacuccaugguagacagaggauggggaaauggauguggauuauuuggaaagggaggcauugugaccugugcuauguucacaugcaaaaagaacauggaaggaaaaaucgugcaaccagaaaauuuggaauacaccaucgugauaacaccucacucaggagaagagcacgcuguagguaaugacacaggaaaacaugguaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacacuggucacuuucaaaaauccccacgcgaagaaacaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggccaaauguuugagacaacaaugagaggagcaaagagaauggcuauuuuaggugacacagccugggauuuuggaucucugggaggaguguuuacaucuauaggaaaggcucuccaccaaguuuucggagcaaucuauggggccgccuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguuguaagcuggaaaaacaaagaacugaaauguggcagcgggaucuucaucacagauaacgugcauacguggacagaacaauacaaguuccaaccagaauccccuucaaaauuagcuucagcuauccaaaaagcucaugaagaggguauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucccacaaccagaccuuucucauugauggcccugaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaaguuaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggacggaugcugguaugggauggaaaucagaccauuaaaagagaaagaagagaauuuggucaacucccuggucacagccggacaugggcagauugacaacuuuucacuaggagucuugggaauggcacuauuccuggaagaaaugcucaggacacgaguaggaacgaaacaugcaauacugcuaguugcaguuucuuuugugacauugauuacugggaacauguccuuuagagauuugggaagaguaaugguuauggugggcgcugccaugacggaugacauagguauaggagugacuuaucuugcccuacuggcagcuuucaaaguaagaccaacuuuugcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugaccaucauggccaucucgugugucccaaaugcagugauacugcaaaacgcauggaaggugagcugcacaauauuggcaacgguguccguuucuccacugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuugaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggaaguccaaguccuggcauuggaaccugggaaaaauccaagagcuguccaaacgaaaccuggacuuuucaaaaccaacaccggaaccauaggcgccguaucuuuggacuuuuccccuggaacgucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguugagaugggugaagcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucugguuggcuuacagaguggcagcugaaggcaucaacuaugcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuagauaaccuagcugugcugcauacggcugaggcagguggaagggcguacaaucaugcucucagugaacugccggagacccuugagacacuacuuuuacugacacuccuggcuacagucacgggaggaauuuucuuauucuuaaugaguggaaaagguguagggaagaugacccugggaaugugcugcauaauaacggcuagcauccuccuauggcaugcacagauacaaccacacuggauagcagcuucaauaauauuggaguuuuuucucauaguuuugcucauuccagagccagaaaaacagagaacaccccaagauaaccaacugaccuacguugucauagccauccucacagugguggccgcaaccauggcaaacgagauggguuuccuggaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuucuugccauuggaugcuacucacaagucaaccccauaacucucacagcagcucuucuuuuacugguagcgcauuaugccauuauagggccaggacuucaagcgaaagcaacuagagaagcucagaaaagagcagcagcaggcaucaugaaaaacccaacagucgauggaauaacagugauugaccuagauccaauacccuaugauccaaaauuugaaaaacagcuaggacaaguaaugcuccugauucucugcgugacucaaguauuaaugaugaggacuacaugggcuuugugugaggcucuaaccuuagcgaccgggcccaucuccacauugugggaagguaauccagggagguuuuggaacacuacuauugcagugucaauggcuaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacuaaagaauguaagagaagucaaaggccugacaaaaggaggaccaggacacgaagaaccaguccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucgucagugaacaugaucucaaggaugcugauuaacagauucacaaugaaacacaagaaagccaccuacgagccagauguugaccuagggagcggaacccgcaacauuggaauugagagugagauaccaaaucuagacauaauaggaaagagaauagagaaaauaaaacaagagcaugaaacaucauggcacuaugaccaggaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccauuuggacaacagcguguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagcuuugggggccauauucacugaugagaacaaauggaagucggcacgcgaggcuguugaagauaguagguuuugggagcugguugacaaggaaagaaaucuccaucuugaagggaagugugaaacauguguguacaacaugaugggaaagagagaaaagaaacuaggggaguucggcaaggcaaaagguagcagagccauaugguacauguggcuuggagcacgcuucuuggaguuugaagccuugggauucuugaaugaggaucacugguucuccagagagaacucccugaguggaguggaaggagaagggcugcacaagcuaggcuacauucuaagagaugugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucggcaccuauggccuuaacacuuucaccaauauggaagcccaacuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuccaugaguuaaucaugaaagacggucgcgugcucguaguuccaugcagaaaccaagaugaacugaucggcagggcccgaauuucccagggagcuggguggucucugaaggagacggccuguuuggggaagucuuacgcucaaauguggagucugauguacuuccacagacgugaccucaggcuggcggcaaacgccauuugcucggcagucccgucacauuggguuccaacaagucgaacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 7033 - RNA, 9876 nt, Artificial Sequence
  derived and/or modified CDS sequence (wt) from DENV-2__FM210227__SS-prME
acagcaggcguaauuauuauguugauuccaacagcgauggcguuccaucuaaccacacguaauggagaaccacacaugaucguugguagacaagagaaagggaaaagucuccuguucaaaacagaggauggugugaacauguguacccuuauggccauagaucuuggugaauugugugaagauacaaucacguacaagugcccccuccucaggcagaaugaaccagaagacauagauuguugguguaacucuacguccacauggguaaccuaugggacgugcaccaccacaggagaacacagaagagaaaaaagaucaguggcacucguuccacauguggguaugggacuggagacacgaacugaaacauggaugucgucagaaggagccuggaaacacgcucagagaauugaaaccuggaucuugagacauccaggcuuuaccauaauggcagcaauccuggcauacaccauaggaacgacacauuuccaaagggcccugauuuucaucuuauugacagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacagaagccaaacaaccugccacucuaaggaaguacuguauagaagcaaagcugaccaacacaacaacagaaucucguugcccaacacaaggggaacccagucuaaaugaagagcaggacaaaagguucgucugcaaacacuccaugguggacagaggauggggaaauggauguggauuguuuggaaagggaggcaucgugaccugugcuauguuuacaugcaaaaagaacauggaaggaaaaaucgugcaaccagaaaaucuggaauacaccaucgugauaacaccucacucaggagaagagcacgcuguagguaaugacacaggaaaacaugguaaggaaaucaaaauaacaccacagaguuccgucacagaagcagaacugacaggcuauggcacagucacgauggagugcucuccgagaacgggccuugauuuuaaugagauggugcugcuacagauggaagacaaggcuuggcuggugcacaggcaaugguuccuagaccugccguuaccauggcuacccggagcggacacacaaggaucaaauuggauacagaaagagacacuggucacuuucaaaaauccccacgcgaagaaacaggaugucguugucuuaggaucucaagaaggggccaugcacacggcacucacaggggccacagaaauccagaugucaucaggaaacuuacuauucacaggacaucucaagugcaggcugagaauggacaaacuacagcucaaaggaaugucauauucuaugugcacaggaaaguuuaaaauugugaaggaaauagcagaaacacaacauggaacaauaguuauuagaguacaauaugaaggagacggcucuccauguaagaucccuuuugaaauaauggauuuagaaaaaagacaugucuuaggucgccugauuacaguuaacccgaucguaacagagaaagauagcccagucaacauagaagcagaaccuccauucggagacagcuacaucauuauaggaguagagccgggacaauugaaacucaacugguuuaagaaaggaaguuccaucggccaaauguuugagacaacaaugagaggagcgaagagaauggccauuuuaggugacacagccugggauuuuggaucccugggaggaguguuuacaucuauaggaaaagcucuccaccaggucuucggagcaaucuauggagcugccuuuaguggggucucauggacuaugaaaauccucauaggagccaucaucacauggauaggaaugaauucacguagcaccucacugucugugucacuaguauuagugggagucauaacacuguacuugggagccauggugcaggcugauaguggcugcguugugagcuggaaaaacaaagaacugaaauguggcagcgggaucuucaucacagauaacgugcacacauggacagaacaauacaaguuccaaccagaauccccuucaaaauuagcuucagcuauccaaaaagcucaugaagagggcauuuguggaauucgcucaguaacaagauuggagaaucugauguggaaacaaauaacaccagaauugaaucacauucuaucagaaaaugagguaaaguugaccaucaugacaggagacauuaaaggaaucaugcaggcaggaaaaagaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuauggcuuuggaguuuucaccaccaacauauggcuaaaauugagagaaaaacaggauguguuuugugacucaaaacucaugucagcagccauaaaagacaacagagccguccaugccgauauggguuacuggauagaaaguacacucaaugacacauggaagauggaaaaggccuccuucauugaaguuaaaagcugccacuggccaaagucacacacccucuggaguaauggaguauuagaaagugagaugauaauuccaaaaaguuuugcugggccagugucacaacacaacuacagaccaggcuaucacacgcaaacagcaggaccuuggcaucuagguaagcuugaaauggacuuugauuucugcgaaggaacuacagugguggugacugaggacugcggaaauagaggacccucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagcaggacaugggcagauugacaacuucucacuaggagucuuggggauggcacuauuccuggaagaaaugcucaggacacgaguaggaacgaaacaugcaauacugcuaguugcaguuucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacuacugagaaagcugaccuccaaggaauuaaugauggcuaccauaggaauugcacuccuuucucaaagcaccauaccagagaccauucuugaacuaacugaugcguuagccuugggcaugaugauccuuaaaauagugagaaauauggaaaaguaccaauuggcagugacuaucauggccaucucgugugucccaaaugcagugauacugcaaaacgcauggaaggugagcugcacaauauuggcagcgguguccguuucuccacugcucuuaacauccucacagcaaaaagcggauuggauaccauuggcguugacgauaaaaggucucaauccaacagccauuuuucuaacaacucuuucgagaaccagcaagaaaaggagcuggccgcuaaaugaggccaucauggcagucgggauggugagcauuuuagccaguucucucuuaaagaaugacauucccaugacagguccauuaguggcuggagggcuccuuacugugugcuacgugcucacuggacgaucggccgauuuggaacuggagagagccaccgaugucaaaugggaagaucaggcagaaauaucaggaagcagcccaauccugucaauaacaauaucagaagauggcagcaugucgauaaagaaugaagaggaagaacaaacacugaccauacuuaucagaacgggauugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagccggaguuuacaaagaaggaacauuccauacaauguggcacgucacacguggcgcuguucugaugcauagagggaagaggauugaaccaucaugggcggacgucaagaaagaccuaauaucauauggaggaggcuggaaacucgaaggagaauggaaggaaggagaggaaguccaaguccuggcauuggaaccuggaaaaaauccaagagcuguccaaacgaaaccuggacuuuucaaaaccaacaccggaaccauaggugccguaucucuggacuuuuccccuggaacgucaggaucuccaauugucgauagaaaaggaaaaguugugggucuuuauggcaaugguguugucacaaggaguggagcauacgugagugcuauagcccagaccgaaaaaagcauugaagacaauccagagauugaagaugacauuuuccgaaagaaaagauugacuaucauggaccuccauccaggagcgggaaagacaaaaagauaccuuccagccauaguuagagaggccauaaaacguggcuuaagaacauuaauccuggcccccacuagagucguggcagcugaaauggaggaagcucuuagaggacucccaauaagauaccaaaccccagccaucagagccgagcauaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccaggaaguagagacccauuuccucagagcaaugcaccaaucauggaugaggaaagagaaaucccugagcgcucguggaacuuuggacaugaaugggucacggauuuuaaagggaagacuguuugguuuguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacguugcaugaaaccaguuauacuaacagauggugaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcgcauuggaaagaagcuaaaaugcuccuagauaacaucaacacaccugaaggaaucauuccuaguauguucgaaccagagcgugaaaaaguggaugccauugauggugaauaccgcuugagaggagaagcaaggaaaaccuuuguggaccuaaugagaagaggggacuuaccagucugguuggcauacagaguggcagcugaaggcaucaacuacgcagacagaaggugguguuuugauggaguuaagaauaaccaaauacuggaagaaaacguggaaguggaaauuuggacaaaagaaggggaaaggaagaaauuaaaacccagaugguuggacgcuaggaucuauucugacccacuggcacuaaaagaauucaaggaauuugcagcuggaagaaagucccuaacccugaaccuaaucacagaaauggguaggcuuccgacuuucaugacucaaaaggcaagagacgcacuggauaaccuagcugugcugcauacggcugaggcagguggaagagcguacaaucaugcucucagugaacugccggagacccuggagacacugcuuuuacugacacuccuggcuacagucacgggaggaaucuuccuauucuuaaugagcggaaaagguguagggaagaugacccugggaaugugcugcauaaucacagcuagcauccuccuaugguaugcacagauacaaccacacuggauagccgcuucaauaauacuggaguuuuuucucauaguuuugcucauuccagaaccagaaaaacagagaacaccccaagauaaccaauugaccuacguugucauagccauccucacaguaguggccgcaacuauggcaaacgaaauggguuuccuggaaaaaaccaagaaagaccucggauugggaaguguugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggauaucggaguuccccuccuugccauuggauguuacucacaaguuaaccccauuacucucacagcagcucuucuuuuauugguagcacauuaugccauuauagggccaggacuucaagcgaaagcaaccagagaagcucagaaaagagcagcagcaggcaucaugaaaaacccaacagucgauggaauaacagugaucgaccuagauccaauacccuaugauccgaaauuugaaaaacaguugggacaaguaaugcuccuaauucucugcgugacucaaguauuaaugaugaggacuacaugggcucugugugaggcucuaaccuuagcgaccgggcccaucuccacauugugggaagguaauccagggagguuuuggaacacuaccauugcagugucaauggccaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucggcaaagcugaggugguucgucgagagaaauauggucacaccagaagggaaagugguggaccucggcuguggcagagggggcuggucauacuauugugggggacuaaagaauguaagagaagucaaaggccugacaaaaggaggaccaggacacgaagaaccuauccccaugucaacauauggauggaaucuaguacgucugcagaguggaguugauguuuuuuucacuccgccagaaaagugugacacacuguugugugacauaggggagucgucaccaaaucccacgauagaagcaggacgaacacucagaguccucagcuugguggaaaauugguugaacaaugacacccaauuuugcauaaagguucucaacccauacaugcccucaguuauagaaaaaauggaaacacugcaaaggaaauauggaggagccuuagugaggaauccacucucacgaaacuccacacaugagauguacuggguauccaaugcuacugggaacauagugucaucagugaacaugauuucaaggaugcugauuaacagauucacaaugaaacacaagaaagcuaccuacgagccagauguugaccuagggagcggaacccgcaacauuggaauugaaagugagauaccaaaucuagacauaauaggaaagagaauagagaaaauaaaacaagagcaugaaacaucauggcacuaugaccaagaccauccauauaaaacaugggcuuaccauggcagcuaugaaacaaaacagacuggaucagcaucauccauggugaacggaguggucagacuacugacaaaaccuugggacgucgucccuaugguaacacaaauggcaaugacagauacgacuccauucggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugaggagcaaugcagcauugggggccauauucacugaugagaacaaauggaaaucggcacgcgaggcuguugaagauaguagguuuugggagcugguugacaaggaaagaaaucuccaucuugaaggaaagugugaaacauguguguacaacaugaugggaaagagagaaaagaaacuaggggaguucggcaaggcaaaagguaguagagccauaugguacauguggcuuggagcacgcuucuuggaguuugaagcccugggauucuugaaugaagaucacugguucucuagagagaacucccugaguggaguggaaggagaagggcugcacaagcuaggcuacauucuaagagacgugagcaagaaggaaggaggagcaauguacgccgaugauacagcaggaugggacacaagaaucacauuagaggacuuaaaaaaugaagaaauggugacaaaccacaugggaggagaacacaagagacuagccgaggccauauuuaaauuaacguaccaaaacaagguggugcgugugcaaagaccaacaccaagaggcacaguaauggauaucauaucgagaagagaccaaagagguagugggcaaguuggcaccuauggccuuaacacuuucaccaauauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggggaugauuguguuguaaaaccuuuagaugacagauuugcaagugcuuuaacagcucuaaaugacaugggaaaaguuaggaaagacauacaacaaugggaaccuucaaaaggauggaacgauuggacacaagugccuuucuguucacaccauuuucaugauuuaaucaugaaagacggccgugugcucgugguuccaugcagaaaccaagaugaacugauuggcagggcccgaauuucccagggagcuggguggucuuugaaggagacggccuguuuggggaagucuuaugcccaaauguggagccugauguacuuccacagacgugaccucaggcuggcggcaaaugccauuugcucagcagucccgucacauuggguuccaacaagucgaacaaccuggucuauacacgccaaacaugaauggaugacgacggaagacaugcugacagucuggaacaggguguggauccaagaaaacccauggauggaagacaaaacuccaguggagucaugggaggaagucccauauuugggaaaaagagaagaccaauggugcggcucauugauugggcuaacaagcagggcuaccugggcaaagaacauccaaacagcaauaaaucaagucagaucccuuauaggcaaugaagaauacacagauuacaugccauccaugaagagauucagaagggaagaggaagaggcagguguccugugguag

SEQ ID NO: 7034 - RNA, 9876 nt, Artificial Sequence
  derived and/or modified CDS sequence (wt) from DENV-2__FM210204__SS-prME
acagcaggcguaauuauuauguugauuccaacagcgauggcguuccaucuaaccacacguaauggagaaccacacaugaucguugguagacaagagaaagggaaaagucuucuguucaaaacagaggauggugugaacauguguacccuuauggccauagaccuuggugaauugugugaagauacaaucacguacaagugcccccuccucaggcagaaugaaccagaagacauagauuguugguguaacucuacguccacauggguaaccuaugggacgugcaccaccacaggagaacacagaagagaaaaaagaucaguggcacucguuccacauguggguaugggacuggagacacgaacugaaacauggaugucgucagaaggagccuggaaacacgcucagagaauugaaaccuggaucuugagacauccaggcuuuaccauaauggcagcaauccuggcauacaccauaggaacgacacauuuccaaagggcccugauuuuuaucuuauugacagcugucgcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacagaagccaaacaaccugccacucuaaggaaguacuguauagaagcaaagcugaccaacacaacaacagaaucucguugcccaacacaaggggaacccagucuaaaugaagagcaggacaaaagguucgucugcaaacacuccaugguggacagaggauggggaaauggauguggauuguuuggaaagggaggcaucgugaccugugcuauguuuacaugcaaaaagaacauggaaggaaaaaucgugcaaccagaaaaucuggaauacaccaucgugauaacaccucacucaggagaagagcacgcuguagguaaugacacaggaaaacaugguaaggaaaucaaaauaacaccacagaguuccgucacagaagcagaacugacaggcuauggcacagucacgauggagugcucuccgagaacgggccuugauuuuaaugagauggugcugcuacagauggaagacaaagcuuggcuggugcacaggcaaugguuccuagaccugccguuaccauggcuacccggagcggacacacaaggaucaaauuggauacagaaagagacacuggucacuuucaaaaauccccacgcgaagaaacaggaugucguugucuuaggaucucaagaaggggccaugcacacggcacucacaggggccacagaaauccagaugucaucaggaaacuuacuauucacaggacaucucaagugcaggcugagaauggacaaacuacagcucaaaggaaugucauacucuaugugcacaggaaaguuuaaaauugugaaggaaauagcagaaacacaacauggaacaauaguuauuagaguacaauaugaaggagacggcucuccauguaagaucccuuuugaaauaauggauuuagaaaaaagacaugucuuaggucgccugauuacaguuaacccgaucguaacagagaaagauagcccagucaacauagaagcagaaccuccauucggagacagcuacaucauuauaggaguagagccgggacaauugaaacucaacugguuuaagaaaggaaguuccaucggccaaauguuugagacaacaaugagaggagcgaagagaauggccauuuuaggugacacagccugggauuuuggaucccugggaggaguguuuacaucuauaggaaaagcucuccaccaagucuucggagcaaucuauggagcugccuuuaguggggucucauggacuaugaaaauccucauaggagccaucaucacauggauaggaaugaauucacguagcaccucacugucugugucacuaguauuagugggagucauaacacuguacuugggggccauggugcaggcugauaguggcugcguugugagcuggaaaaacaaagaacugaaauguggcagugggaucuucaucacagauaacgugcacacauggacagaacaauacaaguuccaaccagaauccccuucaaaauuagcuucagcuauccaaaaagcuuaugaagagggcauuuguggaauucgcucaguaacaagauuggagaaucugauguggaaacaaauaacgccagaauugaaucacauucuaucagaaaaugagguaaaguugaccaucaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggccucgaaacagcagaaugccccaacacaaacagagcuuggaacucgcuggaaguugaagacuauggcuuuggaguuuucaccaccaacauauggcuaaaauugagagaaaaacaggauguguuuugugacucaaaacucaugucagcagccauaaaagacaacagagccguccaugccgauauggguuacuggauagaaagugcacucaaugacacauggaagauggaaaaggccuccuucauugaaguuaaaagcugccacuggccaaagucacacacccucuggaguaauggaguauuagaaagugagaugauaauuccaaaaaguuuugcugggccagugucacaacacaacuacagaccaggcuaucacacgcaaacagcaggaccuuggcaucuagguaagcuugaaauggacuuugauuucugcgaaggaacuacagugguggugacugaggacugcggaaauagaggacccucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagcaggacaugggcagauugacaacuucucacuaggagucuuggggauggcacuauuccuggaagaaaugcucaggacacgaguaggaacgaaacacgcaauacugcuaguugcaguuucuuuugugacauugauuacugggaacauguccuuuaaagaccugggaagagugaugguuauggugggcgcuaccaugacggaugacauagguaugggagugacuuaucuugcccuacuagcagcuuucaaaguuagaccaacuuuugcagcuggacuacuacugagaaagcugaccuccaaggaauuaaugauggcuaccauaggaauugcacuccuuucucaaagcaccauaccagagaccauucuugaacuaacugaugcguuagccuugggcaugaugguccuuaaaauagugagaaauauggaaaaguaccaauuggcagugacuaucauggcuaucucgugugucccaaaugcagugauauugcaaaacgcauggaaggugagcugcacaauacuggcagcgguguccguuucuccacugcucuuaacauccucacagcagaaagcggauuggauaccacuggcguugacgauaaaaggucucaauccaacagccauuuuucuaacaacucuuucgagaaccagcaagaaaaggagcuggccgcuaaaugaggcuaucauggcagucgggauggugagcauuuuagccaguucucucuuaaagaaugacauucccaugacagguccauuaguggcuggagggcuccuuacugugugcuacgugcucacuggacgaucggccgauuuggaacuggagagagccaccgaugucaaaugggaagaucaggcagaaauaucaggaagcagcccaauccugucaauaacaauaucagaagauggcagcaugucgauaaagaaugaagaggaagaacaaacacugaccauacuuaucagaacgggauugcuagugaucucaggacucuuuccagugucaauaccaauuacggcagcagcaugguaccugugggaagugaagaaacaaagggcuggaguauugugggacgucccuucacccccacccgugggaaaggccgaacuggaagauggagccuauagaaucaagcaaaaagggauucuuggauacucccagaucggagccggaguuuacaaagaaggaacauuccauacaauguggcacgucacacguggcgcuguucugaugcauagagggaagaggauugaaccaucaugggcggacgucaagaaagaccuaauaucauauggaggaggcuggaaacucgaaggagaauggaaggaaggagaggaaguccaaguccuggcauuggaaccuggaaaaaauccaagagcuguccaaacgaaaccuggacuuuucaaaaccaacaccggaaccauaggugccguaucucuggacuuuuccccuggaacgucaggaucuccaauugucgauagaaaaggaaaaguugugggucuuuauggcaaugguguugucacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuuaagaacauuaauccuggcccccacuagagucguggcagcugaaauggaggaagcucuuagaggacucccaauaagauaccaaaccccagccaucagagccgagcauaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaggcagcugggauuuucaugacagccacuccuccaggaaguagagacccauuuccucagagcaaugcaccaaucauggaugaggaaagagaaaucccugagcgcucguggaacucuggacaugaaugggucacggauuuuaaagggaagacuguuugguuuguuccaaguauaaaagcgggaaaugacauagcagcuugucucagaaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacguugcaugaaaccaguuauacuaacagauggugaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcgcauuggaaagaagcuaaaaugcuccuagauaacaucaacacaccugaaggaaucauuccuaguauguucgaaccagagcgugaaaagguggaugccauugauggugaauaccgcuugagaggagaagcaaggaaaaccuuuguggaccuaaugagaagaggggacuuaccagucugguuggccuacagaguggcagcugaaggcaucaacuacgcagacagaaggugguguuuugauggaguuaagaauaaccaaauacuggaagaaaacguggaaguggaaauuuggacaaaagaaggggaaaggaagaaauuaaaacccagaugguuggacgcuaggaucuauucugacccacuggcacuaaaagaauucaaagaauuugcagcuggaagaaagucccuaacccugaaccuaaucacagaaauggguaggcuuccgacuuucaugacccaaaaggcaagagacgcacuggauaaccuagcugugcugcauacggcugaggcagguggaagagcguacaaucaugcucucagugaacugccggagacccuggagacacugcuuuuacugacacuccuggcuacagucacgggaggaaucuuccuauucuuaaugagcggaaaagguguagggaagaugacccugggaaugugcugcauaaucacggcuagcauccuccuaugguaugcacagauacaaccacacuggauagccgcuucaauaauauuggaguuuuuucucauaguuuugcucauuccagaaccagaaaaacagagaacaccccaagauaaccaauugaccuacguugucauagccauccucacaguaguggccgcaaccauggcaaacgaaauggguuuccuggaaaaaaccaagaaagaccucggauugggaaguguugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggauaucggaguuccccuccuugccauuggauguuacucacaaguuaaccccauuacucucacagcagcucuucuuuuauugguagcacauuaugccauuauagggccaggacuucaagcgaaagcaaccagagaagcucagaaaagagcagcagcaggcaucaugaaaaacccaacagucgauggaauaacagugaucgaccuagauccaauacccuaugauccaaaauuugaaaaacaguugggacaaguaaugcuccuaauucucugcgugacucaaguauuaaugaugaggacuacaugggcucugugugaggcucuaaccuuagcgaccgggcccaucuccacauugugggaagguaauccagggagguuuuggaacacuaccauugcagugucaauggccaacauuuuuagagggagcuaccuggcuggagcuggacuucuuuuuuccaucaugaagaacacaacaaauacaagaagaggaacuggcaacauaggagagacgcuuggagagaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucggcaaagcugaggugguucgucgagagaaauauggucacaccagaagggaaagugguggaccucggcuguggcagagggggcuggucauacuauugugggggacuaaagaauguaagagaagucaaaggccugacaaaaggaggaccaggacacgaagaaccuauccccaugucaacauauggauggaaucuaguacgucugcagagcggaguugauguuuucuucacuccgccagaaaagugugacacacuguugugugacauaggggagucgucaccaaaucccacgauagaagcaggacgaacacucagaguccucagcuugguggaaaauugguugaacaaugacacccaauuuugcauaaagguucucaacccauacaugcccccaguuauagaaaaaauggaaacacugcaaaggaaauauggaggagccuuagugaggaauccacucucacgaaacuccacacaugagauguacuggguauccaaugcuacugggaacauagugucaucagugaacaugauuucaaggaugcugauuaacagauucacaaugaaacacaagaaagcuaccuacgagccagauguugaccuagggagcggaacccgcaacauuggaauugaaagugagauaccaaaucuagacauaauaggaaagagaauagagaaaauaaaacaagagcaugaaacaucauggcacuaugaccaagaccacccauauaaaacaugggcuuaccauggcagcuaugaaacaaaacagacuggaucagcaucauccauggugaacggaguggucagacuacugacaaaaccuugggacgucgucccuaugguaacacaaauggcaaugacagauacgacuccauucggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugaggagcaaugcagcauugggggccauauucacugaugagaacaaauggaaaucggcacgcgaggcuguugaagauaguagguuuugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuucuuggaguuugaagcccugggauucuugaaugaagaucacugguucucuagagagaacucccugaguggaguggaaggagaagggcugcacaagcuaggcuacauucuaagagacgugagcaagaaggaaggaggagcaauguacgccgaugauacagcaggaugggacacaagaaucacauuagaggacuuaaaaaaugaagaaauggugacaaaccacauggaaggagaacacaagagacuagccgaggccauauuuaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaguuaauuagacagauggagggagaaggaauuuucaaaagcauucagcaccugacagucacagaagaaaucgcuguacagaacugguuagcaagaguggggcgugaaaggcuaucaagaauggccaucaguggggaugauugcguuguaaaaccuuuagaugacagauuugcaagugcuuuaacagcucuaaaugacaugggaaaaguuaggaaagacauacaacaaugggaaccuucaaaaggauggaacgauuggacacaagugccuuucuguucacaccauuuucaugauuuaaucaugaaagacggccgugugcucguaguuccaugcagaaaccaagaugaacugauuggcagggcccgaauuucccagggagcuggguggucuuugaaggagacggccuguuuggggaagucuuaugcccaaauguggagccugauguacuuccacagacgugaccucaggcuggcggcaaaugccauuugcucggcagucccgucacauuggguuccaacaagucgaacaaccuggucuauacacgccaaacaugaauggaugacgacggaagacaugcugacagucuggaacaggguguggauccaagaaaacccauggauggaagacaaaacuccaguggagucaugggaggaagucccauauuugggaaaaagagaagaccaauggugcggcucauugauugggcuaacaagcagggcuaccugggcaaagaacauccaaacagcaauaaaucaagucagaucccuuauaggcaaugaagaauacacagauuacaugccauccaugaagagauucagaagggaagaggaagaggcagguguccugugguag

SEQ ID NO: 7035 - RNA, 9876 nt, Artificial Sequence
  derived and/or modified CDS sequence (wt) from DENV-2__FM210230__SS-prME
acagcaggcgugauuauuauguuaauuccaacagcgauggcguuccauuuaaccacacgaaauggagaaccacacaugaucguuggcagacaagagaaagggaaaagucuucuguuuaaaacagaggauggugugaacauguguacccucauggccauugaccuuggugaauugugugaagauacaaucacguacaagugcccccuccucaggcagaaugaaccagaagacauagauuguuggugcaacuccacguccacauggguaacuuaugggacguguaccaccacaggagaacacagaagagaaaaaagaucaguggcacucguuccacauguggguaugggacuggagacacgaacugaaacauggaugucgucagaaggggccuggaaacacgcucagagaauugaaaccuggaucuugagacauccaggcuuuaccauaauggcagcaauucuggcauacaccguaggaacgacacauuuccaaagggcccugauuuucaucuuauuggcagcugucgcuccuucaaugacaaugcguugcauaggaauaucaaauagagacuuuguagaagggguuucaggaggaagcuggguugacauagucuuagaacauggaaguugugugacgacaauggcaaaaaauaaaccaacacuggauuuugaacugauaaaaacagaagccaaacaaccugccacucuaaggaaguacuguauagaggcaaagcugaccaauacaacaacagaaucucguugcccaacacagggggaacccaguuuaaaugaagagcaggacaaaagguucgucugcaaacacuccaugguagacagaggauggggaaauggauguggauuauuuggaaagggaggcauugugaccugugcuauguucacaugcaaaaagaacauggaaggaaaaaucgugcaaccagaaaauuuggaauacaccaucgugauaacaccucacucaggagaagagcacgcuguagguaaugacacaggaaaacauggcaaggaaauuaaaauaacaccacagagucccaucacagaagcagaacugacaggcuauggcacagucacgauggagugcucuccgagaacgggccuugacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaagcaggaugucguuguuuuaggaucucaagaaggggccaugcacacggcacucacaggggccacagaaauccagaugucaucaggaaacuuacuauucacaggacaucucaaaugcaggcugagaauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacaugucuuaggucgccugauuacaguuaauccgaucguaacagaaaaagauagcccagucaacauagaagcagaaccuccauucggagacagcuacaucauuauaggaguagagccgggacaauugaaacucaacugguucaagaaaggaaguuccaucggacaaauguuugagacaacaaugagaggagcaaagagaauggccauuuuaggugacacagccugggauuuuggaucucugggaggaguguuuacaucuauaggaaaggcucuccaccaaguuuucggagcaaucuauggggcugccuuuagugggguuucauggacuaugaaaauccucauaggagucaucaucacauggauaggaaugaauucacguagcaccucacugucugugucacuaguauuggugggagucauaacacuguacuugggagcuauggugcaggcugauagugguugcguugugagcuggaaaaacaaagaacugaaauguggcagcgggaucuucaucacagauaacgugcacacguggacagaacaauacaaguuccaaccagaauccccuucaaaauuagcuucagccauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggccccgaaacagcagaaugccccaacacaaacagagcuuggaacucgcuggaaguugaagacuaugguuuuggaguuuucaccaccaauauauggcuaaaauugagagaaaaacaggauguguucugugacucaaaacucaugucagcagccauaaaagacaacagagccguccaugccgauaugggcuauuggauagaaagugcacucaaugacacauggaagauggagaaggccucuuucauugaagucaaaagcugccacuggccaaagucacacacccucuggaguaauggaguauuagaaagugagaugauaauuccaaaaaguuuugcugggccagugucacaacacaauuacagaccaggcuauuacacgcaaacagcaggaccuuggcaucuagguaagcuugagauggacuuugauuucugcgaaggaacuacagugguggugacugaggacugcggaaauagaggaccaucuuuaagaacgaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuugggaauggcauuauuucuggaagaaaugcucaggacacgaguaggaacgaaacaugcaauacugcuaguuacaguuucuuuugugacauugauuacugggaacauguccuuuagagaucugggaagagugaugguuauggugggcgcugccaugacggaugacauagguaugggagugacuuaucuugcccuacuggcagcuuucaaaguaagaccaacuuuugcagcuggacuacuacugagaaagcugaccuccaaggaauuaaugauggcuaccauaggaaucgcacuccuuucucaaagcaccauaccagagaccauucuugaacuaacugaugcguuagccuugggcaugaugguccuuaaaauagugagaaauauggaaaaguaccaauuggcagugacuaucauggccaucucgugugucccaaaugcagugauauugcaaaacgcauggaaggugagcugcacaauauuggcagcgguguccguuucuccaaugcucuuaacauccucacagcagaaagcggauuggauaccacuggcauugacgauaaaaggucucaauccaacagccauuuuucuaacaacccuuucgagaacuagcaagaaaaggagcuggccgcuaaaugaggccaucauggcagucgggaugguuaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucaggaagcagcccaauccugucaauaacaauagcagaagauggcagcaugucgauaaaaaaugaagaggaagaacaaacacugacuauacucaucagaacgggacugcuagugaucucaggacucuuuccagugucaauaccaauuacggcagcagcaugguaccugugggaagugaagaaacaacgggcuggaguauugugggacgucccuucacccccacccgugggaaaggccgaacuggaagauggagccuauagaaucaagcaaaaagggauucuuggauacucccagauuggagcuggaguuuacaaagaaggaacauuccauacaauguggcacgucacacguggcgcuguucugaugcauagagggaagaggauugaaccaucaugggcggacgucaagaaagaccuaauaucauauggaggaggcuggaagcucgaaggagaauggaaggaaggagaggagguccaaguccuggcauuggaaccugggaagaauccaagagcuguccaaacgaaaccuggacuuuucaaaaccaacaccggaaccauaggcgccguaucuuuggacuuuuccccuggaacaucaggaucuccaauugucgauagaaaaggaaaaguugugggucuuuauggcaaugguguuguuacaaggaguggagcauacgugagugcuauagcccagaccgaaaaaagcauugaagacaauccagagaucgaagaugacauuuuccgaaagaaaagauugacuaucauggaccuccauccaggagcgggaaagacaaaaagauaccuuccagccauaguuagagaggccauaaaacguggcuugagaacauuaauccuggcccccacuagaguuguggcagcugaaauggaggaagcccuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguagagaugggugaagcagcugggauuuucaugacagccacuccuccgggaaguagagacccauuuccucagagcaaugcaccgaucauggaugaggaaagagaaaucccugagcguucguggaacucuggacaugaaugggucacggauuuuaaagggaagacuguuugguucguuccaaguauaaaagcgggaaaugacauagcagcuugucucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagacccuagacgcugcaugaaaccaguuauacuaacagauggcgaagagcgggugaucuuggcaggacccaugccaguaacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaagaccuuuguggaccuaaugagaagaggggacuuaccagucugguuggcuuacagaguggcagcugaaggcaucaacuacgcagacagaaggugguguuuugauggaguuaagaacaaccaaauacuagaagaaaacguggaaguggaaauuuggacaaaagaaggggaaaggaagaaauuaaaacccagaugguuggaugcuaggaucuauucugacccacuggcacuaaaagaauucaaggaauuugcggcuggaagaaaguccuugacccugaaccuaaucacagaaauggguagacuuccaacuuucaugacccagaaggcaagagacgcacuggauaaccuagcugugcugcauacggcugaggcagguggaagggcguacaaucaugcucucagugaacugccggagacccuggagacacuacuuuuacugacacuccuggcuacagucacgggaggaauuuucuuauucuuaaugagcggaaaagguguagggaagaugacccugggaaugugcugcauaaucacggcuagcauccuccuaugguaugcacagauacaaccacacuggauagcagcuucaauaauauuggaguuuuuucucauaguuuugcucauuccagaaccagaaaaacagagaacaccccaagauaaccaacugaccuacguuguuauagccauccucacagugguggccgcaaccauggcaaacgagauggguuuccuagaaaaaaccaagaaagaccucggauugggaagcauugcaacccaggaaccugagagcaacauccuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauuaucaaagauggacaucggaguuccccuucuugccauuggaugcuacucacaagucaaccccauaacucucacagcagcucuucuuuuacugguagcgcauuaugccauuauagggccaggacuccaagcgaaagcaaccagagaagcucagaaaagagcagcagcaggcaucaugaaaaacccaacagucgauggaguaacagugauugaccuagauccaauacccuaugauccaaaauuugaaaaacagcuaggacaaguaaugcuccugauucucugcgugacucaaguacuaaugaugaggacuacaugggcuuugugugaggcucuaaccuuagcgaccgggcccaucuccacauugugggaagguaauccagggagauuuuggaacacuacuauugcagugucaauggcuaacauuuuuagagggagcuacuuggcuggagcuggacuucuuuuuuccaucaugaagaacacaacaaauacaagaagaggaacuggcaacauaggagagacgcuuggagagaaauggaaaagccgauuaaacgcacuggggaaaagugaauuucagaucuacaagaaaaguggaauccaggaaguggauagaaccuuagcaaaagaaggcaucaaaagaggagaaacggaccaccacgcugugucgcgagguucagcaaaacugagaugguucgucgagagaaacauggucacaccagaagggaaagugguggaccuugguugcggcagagggggcuggucauacuauugugggggacuaaaggauguaagagaagucaaaggccugacaaaaggaggaccaggacacgaagaaccaauccccaugucaacauauggguggaaucuaguacgccugcagaguggaguugauguuuucuucacuccgccagaaaagugugauacauuguugugugacauaggggagucgucaccaaaucccacgauagaagcaggacgaacacucagaguccuuagcuugguggaaaacugguugaacaaugacacccaauuuugcauaaagguucucaacccauauaugcccucagucauagaaaaaauggaaacacugcaaaggaaauauggaggagccuuagugaggaauccacucucacgaaacuccacacaugagauguacuggguauccaaugcuacugggaacauagugucaucagugaacaugaucucaaggaugcugauuaacagauucacaaugaaacacaagaaagccaccuacgagccagauguugacuuagggagcggaacccgcaacauuggaauugaaagugagauaccaaaucuagacauaauaggaaagagaauagagaaaauaaaacaagagcaugaaacaucauggcacuaugaccaagaccacccauacaaaacaugggcuuaccauggcagcuaugaaacaaaacagacuggaucagcaucauccauggugaacggaguggucagacugcugacaaaaccuugggacgucgucccuaugguaacacagauggcaaugacagacacgacuccguuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauauguaccagagaagaauucacaagaaaggugagaagcaaugcagccuugggggccauauucacugaugagaacaaauggaagucggcacgcgaggcuguugaagauagcagguuuugggagcugguugacaaggaaagaaaucuccaucuugaagggaagugugaaacauguguguacaacaugaugggaaagagagaaaagaaacuaggggaguucgguaaggcaaaggguagcagagccauaugguacauguggcuuggagcacgcuucuuggaguuugaagccuugggauucuugaaugaagaucacugguucuccagagagaacucccugaguggaguggaaggagaagggcugcacaagcuaggcuacauucuaagagaugugagcaagaagggaggaggagcaauguacgccgaugauacagcaggaugggacacaagaaucacacuagaagacuuaaaaaaugaagaaauggugacaaaccacauggaaggagaacacaagaaacuagccgaggccauuuuuaaauuaacguaccaaaacaagguggugcgugugcaaagaccaacaccaagaggcacaguaauggauaucauaucgaggagagaccaaagaggcagugggcaagucgguaccuauggccucaacacuuucaccaauauggaagcccaauuaauuagacagauggagggagaaggaguuuucaaaagcauucagcgccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucugaaugacaugggaaaagucaggaaagacauacaacaaugggaaccuucaagaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggguggucuuugaaggagacggccuguuuggggaaguccuacgcucaaauguggagucugauguacuuccacagacgugaccucaggcuggcggcaaaugcuauuugcucggcagucccgucacauugggucccaacaagucgcacaaccuggucuauacacgccaagcaugaauggaugacgacggaagacaugcugacagucuggaacaggguguggauccaagaaaacccuuggauggaagacaaaacuccaguggagucaugggaggaagucccauauuuggggaaaagagaagaccaauggugcggcucauugauugggcuaacaagcagggcuaccugggcaaagaacauccaaacagcaauaaaucaagucagaucccuuauaggcaaugaggaauacacagauuacaugccauccaugaagagauucagaagggaagaggaagaggcagguguccugugguag

SEQ ID NO: 7036 - RNA, 9876 nt, Artificial Sequence
  derived and/or modified CDS sequence (wt) from DENV-2__KC762665__SS-prME
acugcagguauaauuaucaugaugaucccaacagugauggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacggaaacauggaugucaucagaaggggccuggaaacaugcccagagaauugaaacuugggucuugagacauccaggcuucaccauaauggcagcaauccuggcauauaccauaggaacaacauauuuccaaagaguccugauuuucauuuuacugacagccgucacucccucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagagccuagccuaaacgaagaacaggacaaaagguucgucugcaaacacuccaugguagacagaggauggggaaauggaugcggauuauuuggaaagggaggcaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguuguuguuuuaggaucccaagaaggggcuaugcauacagcacucacaggggccacggaaauccagaugucaucaggaaacuuacuguuuacaggacaucuuaagugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggacuuggaaaaaagacauguuuuaggucgcuugauuacagucaacccaauugucacagaaaaagauagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuucggagcuaucuauggggcugccuucagugggguuucauggacuaugaaaauccucauaggagucgucaucacauggauaggaaugaauucacgcagcaccucacugucugugucacuaguauuagugggggucgugacauuguauuugggagucauggugcaggccgauagugguugcguugugaguuggaaaaacaaagaacugaaauguggcagugggauuuuuaucacagacaacgugcacacauggacagaacaauacaaauuccaaccagaauccccuucaaagcuggcuucagccauccagaaggcucaugaagaaggcauuuguggaauccgcucaguaacaagacuggagaaucugauguggaaacaaauaacaccagaauugaaucacauucuaucagaaaaugagguaaaguugacuaucaugacaggagacauuaaaggaaucaugcaggcaggaaaacgaucccugcggccucaacccacugagcugaaguacucguggaaaacauggggcaaagcgaaaaugcuuuccacagagcuucauaaccacaccuuucucauugauggccccgaaacagcagaaugucccaacgcaaacagagcuuggaauucacuagaaguugaagacuauggcuuuggaguauucaccacuaacauauggcugaaauugaaagaaaggcaggaugcauuuugugacucaaaacucaugucagcagccauaaaagacaacagagccguccacgccgauauggguuauuggauagaaagcgcacucaacgacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaucauacacaaacggcaggacccuggcaucuagguaggcuugagauggacuuugauuucugcgaaggaaccacagugguggugacugaggauuguggaaauagaggacccuccuuaagaacaacuacugcuucuggaaaacucauaacagaguggugcugccgaucuugcacauuaccaccacuaagguacagaggugaggauggaugcugguauggaauggaaaucagaccauugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucacacuccucucucagaguaccauaccagagacuauacuugaacugacugacgcguuggcuuuggggaugaugguucucaaaauagugagaaacauggaaaaguaccaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuugcguugacgaucaaaggccucaauccaacagccauuuucuuaacaacccucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaaaaaugaagaagaagaacaaacacugaccauacucauuagaacaggacugcuggugauaucaggacuuuuuccugugucaauaccaaucacagcagcugcaugguaccugugggaagugaaaaaacaacgggcaggaguauugugggaugucccuucacccccaccugugggaaaggccgaacuggaagauggagccuauagaaucaagcagaaagggauccuaggauacucgcagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaaccagcacuggaaccauaggcgccgugucucuggacuuuucuccuggaacgucaggaucuccaaucgucgacaaaaaaggaaaaguugugggccuuuauggcaacggugucgucacaaggaguggaacauaugugagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagccaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugguauuuucaugacagcuaccccuccuggaagcagagacccauuuccucagagcaaugcaccaaucauggaugaagaaagagaaaucccugagcguucguggaacucuggacaugaguggguuacggacuuuaaagggaagacuguuugguuuguuccaaguauaaaagcagggaaugauauagcagcuugccugagaaagaauggaaagaaggugauacaacucagcaggaagacuuuugauuuugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuuuuggauaacaucaacacgccugaaggaaucauucccagcauguucgaaccagaacgugaaaagguggaugccauugauggugaauaccgcuugagaggagaagcgaggaaaacuuuuguggaccuaaugagaagaggagaucuaccagucuggcuagccuacagaguggcagcugaagguaucaacuacgcagacagaagaugguguuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguagacucccaaccuucaugacccagaaagcaaggaaugcacuggacaacuuagcaguccugcauacggcugaagcaggcggaagggcguacaaucaugcucuuagugaacugccggagacucuggaaacauugcuuuuacugacacuuuuggccacagucacgggcggaaucuuccuguucuugaugagcggaaaagguauagggaagaugacccugggaaugugcugcauaaucacggcuaguauucuccuaugguaugcacaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauaguauugaaaauuccucagugaaugugucucuaacagccauugccaaccaagccacaguguuaaugggucuugggaaaggauggccauuaucaaaaauggacaucggaguuccccuucucgcuaucgggugcuauucacaagucaaccccauaacucucacagcagcccuucucuuauugguagcacauuaugcuaucauagggccaggacuccaagcgaaagcaaccagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggagcuaccuggccggagccggacuucucuuuucuaucaugaaaaacacggccaacacaagaaggggaacuggcaacacaggagagacgcuuggagagaaauggaaaaaucgguugaaugcauugggaaagagugaauuccagaucuauaagaaaaguggaauccaggaaguagauagaaccuuagcaaaagaaggcaucaaaagaggagaaacagaccaucacgcugugucgcgaggcucagcgaaacugagaugguucgucgagagaaaccugguugcaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacuuugcugugugacauaggggagucgucaccaaacccuacgguugaggcaggacgaacacucagaguucuaaacuuaguggaaaauuggcugaauaacaacacccaauuuugcauaaagguucucaacccauacaugcccucaguuauagaaaaaauggaagcgcuacaaaggaaauauggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacaaauggcaaugacagacacgacuccauuuggacaacagcgcgucuucaaagagaaaguggacacaagaacccaagaaccgaaagaaggcacaaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaccuccaucuugaaggaaagugugagacauguguguauaacaugaugggaaagagagagaaaaaacuaggggaguucggcaaagcaaaaggcagcagagccauaugguacauguggcuuggagcacgcuucuuagaguucgaagcucuaggauuccugaaugaagaucacugguuuuccagagagaacucccugaguggaguggaaggagaaggacugcacaaacuaggcuacauuuuaagagacgugaguaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucacuaacauggaagcccaacugaucagacagauggaaggagaaggagucuucaaaagcauccagcaacugacagucacagaagaaauugcagugaaaaacugguuagugagaguggggcgugagagguuaucaagaauggcuaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccgggugguccuugcgggaaacagccuguuugggaaaguccuacgcccaaauguggagccugauguacuuccacagacgugaccuuagacuggcggcaaaugccauuugcucggcaguuccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggcuaccugggcaaagaacauccaaacagcaauaaaucaagucagaucccuaauaggcaaugaggaauacacagacuacaugccauccaugaaaagauucagaagagaagaggaagaggcaggagucuugugguag

SEQ ID NO: 7037 - RNA, 9876 nt, Artificial Sequence
  derived and/or modified CDS sequence (wt) from DENV-2__KC762669__SS-prME
acugcagguauaaucauuauggugauuccaacagugauggcguuccauuuaaccacacgcaacggagaaccacacaugaucgucaguagacaagagaaagggaaaagucuucuguuuaaaacagagaacggugugaacaugugcacccucauggccauggaccuuggugaacugugugaagacacaaucacuuacaauuguccucuucucaggcagaaugaaccagaagacauagacuguuggugcaacucuacgucuacauggguaacuuaugggacaugcaccgcuacaggagaacacagaagggaaaaaagaucaguggcacucguuccacaugugggaaugggacuggagacacgaacugaaacauggaugucaucagaaggggccuggaaacaugcacaaagaauugagacuugggucuugagacauccaggcuucaccauaauggcagcaauccuggcauacaccauaggaacgacauacuuccaaagaguccugauuuucaucuuacugacagcugucgcuccuucaaugacaaugcguugcauaggaauaucaaauagagacuuuguggaagggguuucaggaggaagcuggguugacauaguuuuggaacauggaagcugugugacgacgauggcgaaaaauaaaccaacauuggauuuugaacugauaaagacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggagggaaaaaucgugcagccagaaaaccuggaguacaccauugugauaacaccucacucaggggaagagaaugcagucggaaaugacacaggaaaacacggcaaggaaauuaaaguaacaccacagaguuccaucacagaagcagaacuaacaggcuauggcacuguuacgauggaaugcucuccgagaacgggacucgacuucaaugagaugguguugcugcaaauggaaaacaaggcuuggcuggugcacaggcaaugguucuuagaccugccauuaccauggcugcccggagcagacacacaaggaucaaauuggauacagaaggagacauuggucacuuucaaaaauccccacgcaaagaaacaggauguuguuguuuuaggaucccaagaaggggcuaugcacacagcacucacaggggccacggaaauccagaugucaucaggaaacuuacuguucacaggacaucuuaaauguaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggauuuggaaaaaagacaugucuuaggccgcuugauuacagucaacccaauugucacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggaccaugaaaauccucauaggaguuguuauuacauggauaggaaugaauucacgcagcaccucacugucugugucacuaguauuagugggagucgugacauuguauuugggaguuauggugcaggccgauagugguugcguugugagcuggaaaaacaaagaacugaaauguggcagugggauuuuuaucacagacaacgugcacacauggacagaacaauacaaauuucaaccagaauccccuucaaagcuggcuucagcuauccagaaggcucaugaagaaggcauuuguggaauccgcucaguaacaagacuggagaaucugauguggaaacaaauaacaccagaacugaaucacauucuaucagaaaaugaggugaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucacuagagguugaagacuauggcuuuggaguauucaccaccaacauauggcugaaauugaaagaaaggcaggauguauuuugugacucaaaacucaugucagcagccauaaaagacaacagagccguccacgccgacauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaaccacagugguggugacugaggacuguggaaauagaggacccucuuuaagaacaacuaccgcuucuggaaaacucauaacagaauggugcugccgaucuugcacauuaccaccgcuaagguacagaggugaggauggaugcugguauggaauggaaaucagaccauugaaggagaaagaagagaauuuggucaacucuuugguuacagccggacauggacagauugacaacuucucacuaggagucuugggaauggcauuguuccuggaagagaugcucagaacccgaguaggaacgaaacaugcaauauuacuaguugcagucucuuucgugacauugaucacagggaacauguccuuucgagauuuggggagagugauggucaugguaggcgcuacuaugacggaugacauaggcaugggcgugacuuaucuugcccuauuagcagccuucaaggucagaccaacuuuugcagcuggacuacucuuaagaaagcugaccuccaaagaauugaugaugaccaccauaggaaucguacuccucucucagagcaccauaccagagacuauacuugaacugacugacgcguuggcuuuggggaugaugguucucaaaauaguaagaaacauggaaaaguaucaacuagcagugacuaucauggcuaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuaguaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuagagagagcugcugacguaagaugggaagaacaggcagagauaucaggaagcaguccaauucugucgauaacaauaucggaagaugguagcaugucgauaaaaaaugaagaagaagaacaaacacugaccauacugauuagaacaggacugcuggugauaucaggacuuuuucccgugucaauaccaaucacggcagcugcaugguaccugugggaagugaaaaaacaacgagccggaguauugugggaugucccuucgccuccaccugugggaaaggccgaacuggaagauggagccuauagaaucaagcagaaagggauucuaggauacucgcagaucggagccggagucuacaaagaaggaacauuccacacaauguggcaugucacacguggugcuguucuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaucauaggcgccgugucucuggacuuuucuccuggaacgucaggaucuccaauugucgacaaaaaaggaaaaguugugggccuuuauggcaacggugucgucacaaggaguggaacauaugugagugccauagcccagacugaaaaaagcauugaagacaacccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauuuccucagagcaacgcaccaaucauggaugaagaaagggaaauuccugaacguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauuuugaauauaucaagacuaggaccaaugauugggacuuuguggucacgacagacauuucagaaaugggugcuaacuucaaggcugagaggguuauagaccccagacgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugcgcacacuggaaagaagcuaagaugcuucuagauaacaucaacacgccugaaggaaucauucccagcauguucgaaccagagcgugaaaaggucgacgccauugauggugaauaccgcuugagaggagaagcgaggaaaacauuuguggaccuaaugagaagaggagaccuaccagucuggcuagccuauagaguggcagcugaagguaucaacuacgcagacagaagauggugcuuugauggagucaagaacaaccaaaucuuggaagaaaauguggaaguagaaauuuggacaaaagaaggagaaaggaagaaauuaaaacccagaugguuagaugcuaggaucuacucugacccacuggcgcucaaagaauucaaggaauucgcagcuggaagaaaaucccugaccuugaaucuaaucaccgagauggguaggcucccaaccuucaugacccagaaagcaaggaaugcacuggacaacuuagcaguccugcauacagcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggccaguauucuccuaugguaugcacaaauacagccacauuggauagcagcuucaauaauacuggaguuuuuucuaauagucuugcucauuccagaaccagaaaagcagagaacaccccaagacaaccaauuaacuuaugucgucauagccauccuuacagugguggccgcaaccauggcaaacgagauggguuuccuggaaaaaacaaagaaagauuucggauugggaagcauuacaacccagcaacuugagagcaacauccuggacauagaucuacguccugcaucagcuuggacucuauaugccguggcaacaacuuucaucacaccaauguugagacauagcauugaaaauuccucagugaaugugucucuaacagccauugccaaucaagccacaguguuaaugggucuugggaaaggauggccauugucgaaaauggacaucggaguuccccuucucgcuaucggaugcuacucacaagucaaccccauaacucucacagcagcccuucucuuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaggcccuaaccuuagcgaccgggcccaucucuacacugugggaaggaaauccagggagauuuuggaauacaacuauugcagugucaauggcuaacauuuuuagagggaguuaccuggccggagcuggacuucucuuuucuaucaugaagaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaaggcaucaagagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgucuucaaaguggagucgaugucuuuuuuacuccgccagaaaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaauagauucacaaugagacacaagaaggccacauacgagccagauguugaucucggaaguggaacccgcaacaucggaauugaaagugagacaccaaaucuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagagggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucgguaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuugaaaaaugaagaaauggugacaaaccacauggaaggagaacacaagagacuugccgaagccauuuucagauuaacguaccaaaacaaaguggugcgugugcaaagaccgacaccaagaggcacaguaauggacaucauaucgagaagagaccaaagagguaguggacaaguugucaccuacggccucaauacuuucaccaacauggaagcccaacugaucagacagauggagggagaaggagucuucaaaagcauccagcaccugacagucacagaagaaauugcagugaaaaacugguuagcaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacuuguaguuccauguagaaaccaagaugaacugauugguagggcccgaauuucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7038 - RNA, 9876 nt, Artificial Sequence
  derived and/or modified CDS sequence (wt) from DENV-2__KC762658__SS-prME
acugcagguauaauuauuaugaugaucccaacagugauggcguuccauuuaaccacacgcaacggagaaccacacaugaucgucaguagacaagagaaggggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccccaggagaacacagaagggaaaaaagaucaguggcacucguuccccaugugggaaugggacuggagacacgaacugaaacauggaugucaucagaaggggccgggaaacacgcccagagaauugaaacuugggucuuaagacauccaggcuuuaccauaauggcagcaauccuggcauacaccauaggaacaacauauuuccaaagaguccugaucuucauuuuacugacagcugucacucccucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacuucccgccacucuaaggaaguauuguauagaagcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuagucacuuucaaaaauccccaugcaaagaaacaggauguuguuguuuuaggaucccaagaaggggccaugcauacagcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggacuuggaaaaaagacaugucuuaggucgcuugauuacagucaacccaauugucacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagccaucuauggggcugccuucagugggguuucauggacuaugaaaauccucauaggagucgucaucacauggauaggaaugaauucacgcagcaccucacugucugugucacuaguauuagugggggucgugacuuuguauuugggaguuauggugcaggccgauagugguugcguugugaguuggaaaaacaaagaacugaaauguggcagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaagcaaauaacaccagaauugaaucacauucuaucagaaaaugagguaaaguugacuauuaugacaggagacauuaaaggaaucaugcaggcaggaaaacgaucccugcggccucaacccacugagcugaaguacucuuggaaaacauggggcaaagcgaaaaugcuuuccacagagcuucauaaccacaccuuucucauugauggccccgaaacagcagaauguccuaacacaaacagagcuuggaacucacuagaaguugaagacuauggcuuuggaguauucaccacuaacauauggcugaaauugaaagaaaggcaggauguauuuugugacucaaaacucaugucagcagccauaaaagacaacagagccguccacgccgauauggguuauuggauagaaagugcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaucauacacaaacggcaggacccuggcaucuagguaggcuugagauggacuuugauuucugcgaaggaaccacagugguggugaccgaggacuguggaaauagaggacccucccuaagaacaaccacugcuucuggaaaacucauaacagaguggugcugccgaucuugcacauuaccaccgcuaagguacagaggugaagauggaugcugguauggaauggaaaucagaccauugaaagagaaagaagagaacuuggucaacucuuuggucacagccggacauggacagauugacaacuucucacuaggagucuugggaauggcauuguuccuggaagagaugcucagaacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcucuauuagcagccuucaaagucagaccaacuuuugcggcuggacuacucuuaagaaagcugaccuccaaggaauugaugaugaccaccauaggaaucguacuccucucucagaguaccauaccagagacuauacuugaacugacugacgcguuggcuuuggggaugaugguucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacaaucaaaggccucaauccaacagccauuuucuuaacaacccucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaagcaguccaauucugucgauaacaauaucggaagaugguagcaugucgauaaaaaaugaagaagaagaacaaacacugaccauacucauuagaacaggacugcuggugauaucaggacuuuuuccugugucaauaccaaucacggcagcugcaugguaccugugggaagugaaaaaacaacgagcaggaguauugugggaugucccuucacccccaccugugggaaaggccgaacuggaagauggagccuauagaaucaagcagaaagggauccuaggauacucgcagauuggagccggaguuuauaaagaaggaacauuccacacaauguggcaugucacacguggugcuguccuaaugcauaaagggaagagaauugaaccaucaugggcggacguuaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccaggaacgucaggaucuccaaucgucgacaaaaaaggaaaaguugugggccuuuauggcaacggugucgucacaaggaguggaacauaugugagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagagguuacauuucaacucgaguagagaugggugaagcagcugguauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcggccugccugagaaagaauggaaagaaagugauacaacucagcaggaagacuuuugauuuugaauacaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaacccaaaaaaugaaaaugaccaguacauauacaugggggaaccucuggaaaaugaugaagacugugcacacuggaaagaagcuaagaugcuuuuggauaacaucaacacgccugaaggaaucauucccagcauguucgaaccagagcgugaaaagguggaugccauugauggugaauaccgccugagaggagaagcgaggaaaaccuuuguggaacuaaugagaagaggagaucuaccagucuggcuagccuacagaguggcagcugaagguaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuagaaucuacucugacccacuggcgcucaaagaauucaaggaauucgcagcuggaagaaagucccugacccugaaucuaaucacagagauggguagacucccaaccuucaugacccagaaagcaaggaaugcacuagacaacuuagcagucuugcauacggcugaagcaggcggaagggcguacaaucaugcucuuagugaacugccggagacucuggaaacauugcuuuuacugacacuuuuggccacagucacgggcggaaucuuccuguucuugaugagcggaaaggguauagggaagaugacccugggaaugugcugcauaaucacggcuaguauucuccuaugguaugcacaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaaccauggcaaacgagauggguuuccuggaaaaaacaaagaaagauuuuggauugggaagcauuacaacccagcaaccugagaguaacauccuggacauagaucuacguccugcaucagcuuggacucuauaugccguggcaacaacuuucaucacaccaauguugaggcauagcauugaaaauuccucagugaaugugucucuaacagccauugccaaccaagccacaguguuaaugggucuugggaaaggauggccauuaucaaaaauggacaucggaguuccccuucucgcuaucgggugcuauucacaagucaaccccauaacucucacagcagcccuucucuuauugguagcacauuaugcuauuauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuaucgcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacggaccaucacgcagugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgucuucaaagcggaguugauguuuuuuuuacuccgccagaaaagugugacacauugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaaggauguugauuaacagauucacaaugagacacaagaaagccacauacgagccagauguugaccucggaaguggaacccgcaacaucggaauugaaagugagacaccaaauuuagacauaauugggaaaagaauagagaaaauaaaacaagagcaugaaacaucauggcacuaugaccaagaccacccauacaaaacgugggccuaccauggcagcuacgaaacaaaacagacaggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcggccuuaggugccauauucacugaugagaacaaguggaagucggcacgugaggcuguugaagacaguggauuuugggaauugguugacaaggaaaggaaccuccaucuugaaggaaagugugagacauguguguauaacaugaugggaaagagagagaagaagcuaggggaauucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgaggagagaccaaagagguaguggacaaguugucaccuacggccucaauacuuucaccaacauggaagcccaacugaucagacagauggagggagaaggagucuucaaaagcauccagcaacugacagucacagaagaaauugcagugaaaaacugguuaguaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugccuuuuuguucacaccauuuccaugaguuaaucaugaaggacggucguguacucguaguuccaugcagaaaccaagaugaacugauugguagggcccgaauuucccagggagccgggugguccuugcgggaaacagccuguuuggggaaguccuacgcccaaauguggagccugauguacuuccacagacgugaccuuaggcuggcagcaaaugccauuugcucggcagucccaucacauuggguuccaacaagucgaacaaccugguccauacacgccacacaugaguggaugacaacagaagacaugcugacagucuggaacagggucuggauucaagaaaacccauggauggaagacaaaacuccaguagaaucaugggaggaaaucccguauuuggggaaaagagaagaccaauggugcggcucauugauugggcuaacaagcagagcuaccugggcaaagaacauccaaacagcaauaaaucaaguuagaucccuaauaggcaaugagaaauacacagacuacaugccauccaugaaaagauucagaagagaagaggaagaggcaggagucuugugguag

SEQ ID NO: 7039 - RNA, 9876 nt, Artificial Sequence
  derived and/or modified CDS sequence (wt) from DENV-2__KC762660__SS-prME
acugcaggcauaauuauuaugaugaucccaacagugauggcguuccauuuaaccacacgcaacggagaaccacacaugaucgucaguagacaagagaaagggaaaagucuucuguuuaaaacagagaacggugugaacaugugcacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuuuaccauaauggcagcaauccuggcauacaccauaggaacaacauauuuccaaagaguccugauuuucauuuuacugacagcugucacuccuucaaugacaaugcguuguauaggaauaucaaauagagacuuuguggaagggguuucaggaggaagcuggguugauauagucuuggaacauggaagcugugugacgacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaaaggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacacggcaaggaaauuaaaguaacaccacagaguuccaucacagaagcagaauuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugccuggagcagacacacaaggaucaaauuggauacagaaggagacacuggucacuuucaaaaauccucaugcaaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggacuuggaaaaaagacaugucuuaggucgcuugauuacagucaacccaauugucacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauagggaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacgugcacacauggacagaacaauacaaauuucaaccagaauccccuucaaagcuggcuucagcuauccagaaggcucaugaagaaggcauuuguggaauccgcucagugacaagacuggagaaucugauguggaaacaaauaacaccagaauugaaucacauucuaucagaaaaugagguaaagcugacuaucaugacaggagacauuaaaggaaucaugcaggcaggaaaacgaucccugcggccucaacccacugagcugaaguacucuuggaaaacauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguauuuugugacucaaaacucaugucagcagccauaaaagacaacagagccguccacgccgauauggguuauuggauagaaagcgcacucaaugacacauggaagauugaaaaagccucuuucauugaaguuaaaagcugccacuggccaaagucacacacucucuggaguaauggagugcuggaaagugagaugauaauuccaaagaauuuugcaggaccagugucacaacacaauuacagaccaggcuaucauacacaaacagcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgcucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugacuaccauaggaaucguacuccucucucagaguaccauaccagagagcauacuugaacugacugacgcguuggcuuuggggaugaugguucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuaguaagaaaaggagcuggccacuaaaugaggcuauuauggcagucgggauggugagcauucuagccaguucccucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauccugucgauaacaauaucggaagaugguagcaugucgauaaaaaaugaagaagaagaacaaacacugaccauacucauuagaacaggacugcuggugauaucaggacuuuuuccugugucaauaccaauuacggcagcugcaugguaccugugggaagugaaaaaacaacgagcaggaguauugugggaugucccuucacccccaccugugggaaaggccgaacuggaagauggagccuauagaaucaagcagaaagggauccuaggauacucgcagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaacccaagagccguccaaacgaaacccggucuuuuuaaaaccaacacuggaaccauaggcgccgugucucuggacuuuucuccuggaacgucaggaucuccaaucgucgacaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugauuaucauggaugaagcccauuucauagacccagcaagcauagcagccagaggauacauuucaacucgaguggagaugggugaagcagcugggauuuucaugacagccaccccuccuggaagcagagacccauuuccucagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaagacuuuugauuuugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccacucuagugcagcacaaagaagagggagaguaggaagaaauccaaaaaaugaaaaugaccaguacauauacaugggggaaccuuuggaaaaugaugaagacugugcacacuggaaagaagcuaagaugcuuuuggauaacaucaacacgccugaaggaaucauucccagcauguucgaaccagagcgugaaaagguggaugccauugauggugaauaccgcuugagaggagaagcgaggaaaaccuuuguggaccuaaugagaagaggagaucuaccagucugguuagccuacagaguggcagcugaagguaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguagacucccaaccuucaugacccagaaagcaaagaaugcacuggacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauucuccuaugguaugcacaaauacagccacacuggauagcagcuucaauaauacuggaguuuuuucucauagucuugcucauuccagaaccagaaaagcagagaacaccccaagacaaccaguuaacuuauguugucauagccauccucacagugguggccgcaacuauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaaugcugaggcauagcauugaaaauuccucagugaaugugucucuaacagccauugccaaccaggccacaguguuaaugggucuugggaaaggauggccauuaucaaaaauggacaucggaguuccccuucucgcuaucgggugcuauucacaagucaaccccauaacucucacagcagcccuucucuuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagcuggacuucucuuuucuaucaugaaaaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacauugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcguguuuucaaagagaaaguggacacgagaacucaagaaccgaaagaaggcacgaaaaaauuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguacaacaugaugggaaagagagagaagaagcuaggggaguucggcaaagcaaaaggcagcagagccauaugguacauguggcuuggagcacgcuucuuagaguuugaagcuuuaggauucuugaaugaagaucacugguuuuccagagagaacucccugaguggaguggaaggagaagggcugcacaaacuaggcuacauuuuaagagaugugaguaagaaagaaggaggagcaauguaugccgaugacaccgcaggaugggacacaagaaucacacuagaggacuuaaagaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucacuuacggccucaauacuuucaccaacauggaagcccaacugaucagacagauggagggagaaggagucuucaaaagcauccagcaacugacagucacagaagaaauugcagugaaaaacugguuaguaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcaggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaauuccguauuuggggaaaagagaggaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuuaugguag

SEQ ID NO: 7040 - RNA, 9876 nt, Artificial Sequence
  derived and/or modified CDS sequence (wt) from DENV-2__KC762676__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacucucauggccauggaccuuggugaacugugugaagacacaaucacuuauaauuguccucuccucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcuuacacuauaggaacgacacauuuccaaagaguccugaucuucaucuuacugacagcugucgcuccuucaaugacaaugcguugcauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaagggaaaauugugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuaugguacuguuacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggcuaugcacacagcacucacaggggccacggaaauccagaugucaucaggaaacuuacuguucacuggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccauguaagaucccuuuugaaauaauggauuuggaaaaaagacauguccuaggucgcuugauuacagucaacccaauugucacagaaaaagacagcccagucaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuugggagggguguucacauccauaggaaaggcccuccaccaagucuuuggagcaaucuauggggcugccuucagugggguuucauggacuaugaaaauccucauaggagucgucaucacauggauaggaaugaauucacgcagcacuucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggccucagcuauccagaaggcucacgaagaaggcauuuguggaauccgcucaguaacaagacuggagaaucugauguggaaacaaauaacaccagaacugaaucacauucuaucagaaaaugaggugaaguugacuaucaugacaggagacauuaaaggaaucaugcaggcaggaaaacgaucccugcggccucaacccacugagcugaaguacucuuggaaaacauggggcaaagcgaaaaugcucuccacagagcuucacaaccacaccuuucucauugauggccccgaaacagcagaaugucccaacacaaacagagcuuggaacucacuagaagucgaagacuauggcuuuggaguauucaccaccaacauauggcugaaauugaaagaaaggcaggauguauauugugacucaaaacucaugucagcagccauaaaagauaacagagccguccacgccgauauggguuauuggauagaaagcgcacucaaugacacauggaagauugagaaagccucuuuuauugaaguuaaaagcugcuacuggccaaagucacacacccucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaaccacagugguggugacugaggacuguggaaauagaggacccucuuuaagaacaacuacugcuucuggaaaacucauaacagaguggugcugccgaucuugcacauuaccaccacuaagguacagaggugaggauggaugcugguauggaauggaaauuagaccacugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggauuacucuuaagaaagcugaccuccaaggaauugaugaugaccaccauaggaaucgugcuccucucccagagcaccauaccagagacuauacuugaacugacugacgcauuggcuuuggggaugauggcucucaaaauagugagaaacauggaaaaguaucaacuagcagugacuaucauggccaucuugugcguuccaaaugcagugauauuacaaaacgcauggaaagugagcugcacaacacuggcagugguguccguuuccccacugcuuuuaacauccucacagcagaaagcggauuggauaccacuggcguugacgaucaaaggccuuaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacguacucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuagugauaucaggacuuuuucccguaucaauaccaaucacggcagcugcaugguaccugugggaagugaaaaaacaacgagcaggaguauugugggauguccccucacccccaccugugggaaaggccgaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaaguuagaaggagaauggaaagaaggagaagaaguccagguccuggcauuagagccuggaaagaauccaagagcuguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaacggugucguuacaaggaguggaacauaugugagugcuauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaacuugauuaucauggaugaagcccauuucacagacccagcaagcauagcagcuagaggauacauuucaacucgaguagagaugggugaagcagcugggauuuucaugacagcuaccccuccuggaaguagagacccauuuccucagagcaaugcaccaaucauggaugaagaaagggaaaucccugagcguucguggaacucuggacaugaauggguuacggauuuuaaagggaagacuguuugguuuguuccaagcauaaaagcagggaaugauauagcagcuugccugagaaagaauggaaagaaagugauacaacucagcaggaagacuuuugauuuugaauauauuaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaaaaugcuccuagacaacaucaacacgccugaaggaaucauucccagcauguucgaaccagagcgugaaaagguggaugccauugauggugaauaccgcuugagaggagaagcaagaaaaacuuuuguggaccuaaugagaagaggagaccuaccagucugguuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauugaaacccagaugguuggaugcuaggaucuauucugacccacuggcgcucaaagaauucaaggaauucgcagcuggaagaaagucccugacccugaaucuaaucacagagauggguaggcucccaaccuucaugacccagaaagcaaggaaugcacuggacaacuuagcagucuugcauacagcugaagcaggcggaagggcguacaaucaugcucuuagugaacugccggagacucuggagacauugcuuuuacugacacucuuggccacagucacgggcggaaucuuccuguucuugaugaguggaaaggguauagggaagaugacccugggaaugugcugcauaaucacggccaguauucuccuaugguaugcacaaauacagccacacuggauagcagcuucaauaauacuggaguuuuuucucauaguuuugcucauuccagaaccagaaaagcagagaacaccccaagauaaccaauuaacuuauguugucauagccauccuuacagugguggccgcaaccauggcaaaugagauggguuuccuggaaaaaacaaagaaagauuucggauugggaagcauuacaacccagcaaccugagagcaauauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuucccuucucgcuaucgggugcuauucacaagucaaccccauaacucucacagcagcccuucucuuauugguagcacauuaugcuaucauagggccaggacuccaagcgaaagcaacuagagaggcucaaaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccaggaagauucuggaauacaacuauugcagugucaauggcuaacauuuuuagagggaguuacuuggccggagccggacuucucuuuucuaucaugaagaacacggcuaacacaagaaggggaacuggcaacacaggagagacgcuuggagagaaauggaaaaaccgguugaaugcauuggggaagagugaauuccagaucuauaagaaaaguggaauccaggaaguggauagaaccuuggcaaaagaaggcaucaaaagaggagaaacagaccaucacgcugugucgcgaggcucggcgaaacugagaugguucgucgagagaaaccuggucacaccagaagggaaaguaguggaccuugguugcggcagggggggcuggucauacuauugugggggacuaaagaauguaaaagaagucaaaggccuaacaaaaggaggaccaggacacgaagaacccauucccaugucaacauauggcuggaaucuggugcgucuucaaaguggaguugauguuuuuuucacuccgccagaaaagugugauacauugcugugugacauaggggagucgucaccaaaccccacgguugaagcaggacgaacucucagaguucuaaacuuaguggaaaauuggcugaacaacaacacccaauuuugcauaaagguucucaacccauauaugcccucaguuauagaaaaaauggaagcacuacaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagauguugaccucggaaguggaacccgcaacaucggaauugaaagugagauaccaaauuuagacauaauugggaaaagaauagaaaaaauaaaacaagagcaugaaacaucauggcauuaugaccaagaucacccauacagaacgugggccuaucauggcagcuacgaaacaaaacagacuggaucagcaucauccauggugaacggagugguuagguugcuaacaaaaccuugggacguuaucccuauggugacacagauggcaaugacagauacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaaguaaugcagccuuaggcgccauauucacugaugagaacaaguggaagucggcacgugaggcuguugaagacaguggauuuugggaauugguugacaaggaaaggaaucuccaucuugaaggaaagugugagacauguguauauaacaugaugggaaagagagagaagaagcuaggggaguucggcaaagcgaaaggcagcagagccauaugguacauguggcuuggagcacgcuucuuagaguuugaagcccuaggauucuugaacgaagaucacugguuuuccagagagaacucccugaguggaguggaaggagaagggcugcacaaacuaggcuacauuuuaagagacgugaguaagaaagaaggaggagcaauguacgcugaugacaccgcaggaugggacacaagaaucacauuagaggacuuaaaaaacgaagaaauggugacaaaccacauggaaggagaacacaagaaacuugcugaagccaucuucaaauuaacguaccaaaacaagguggugcgugugcaaagaccaacgccaagaggcacaguaauggacauuauaucgagaagagaccaaagagguagcggacaaguugucaccuacggccucaauacuuucaccaacauggaagcccaacugaucagacagauggaaggagaaggagucuucaaaagcauccagcaauugacagucacagaagaaauugcagugaaaaacugguuaguaagaguggggcgugagagguuaucaagaauggccaucaguggagaugauuguguugugaaacccuuagaugacagguuugcaaacgcucuaacagcucuaaaugacaugggaaagguuaggaaagacauacaacaaugggaaccuucaagaggauggaacgauuggacacaagugccuuuuuguucacaccauuuccaugaguuaaucaugaaggacggucguguacucguaguuccaugcagaaaucaagaugaacugauugguagggcccgaauuucccagggagccgggugguccuugcgggaaacagccuguuuggggaagucuuacgcccaaauguggagccugauguacuuccacagacgugaccuuaggcuggcagcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaauuccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagggaagaggaagaggcaggagucuugugguag

SEQ ID NO: 7041 - RNA, 9876 nt, Artificial Sequence
  derived and/or modified CDS sequence (wt) from DENV-2__KC762662__SS-prME
acugcagguauaauuaucaugaugaucccaacagugauggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacggaaacauggaugucaucagaaggggccuggaaacaugcccagagaauugaaacuugggucuugagacauccaggcuucaccauaauggcagcaauccuggcauauaccauaggaacaacauauuuccaaagaguccugauuuucauuuuacugacagcugucacucccucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacauccugccacucuaaggaaguauuguauagaggcaaagcugaccaacacaacaacagcaucucguugcccaacacaaggagaaccuagccuaaacgaagaacaggacaaaagguucgucugcaaacacuccaugguagacagaggauggggaaauggaugcggauuauuuggaaagggaggcaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacauggcaaggaaauuaaaguaacaccacagaguuccaucacagaagcagagcuaacaggcuauggcacugucacgauggaaugcucuccgagaacgggccucgacuucaaugagaugguguugcugcaaauggaaaauaaggcuuggcuggugcacaggcaaugguucuuagaccugccguuaccauggcugcccggagcagacacacaaggaucaaauuggauacagaaggagacauuggucacuuucaaaaacccccaugcaaagaaacaggauguuguuguuuuaggaucccaagaaggggcuaugcauacagcacucacaggggccacggaaauccagaugucaucaggaaaccuacuguucacaggacaucuuaagugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggacuuggaaaaaagacauguuuuaggucgcuugauuacagucaacccaauugucacagaaaaagauagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaaaagaauggccauuuuaggugacacagcuugggauuuuggaucccugggaggaguguucacaucuauaggaaaggcccuccaccaagucuucggagcuaucuauggggcugccuucagugggguuucauggacuaugaaaauccucauaggagucgucaucacauggauaggaaugaauucacgcagcaccucacugucugugucacuaguauuagugggggucgugacauuguauuugggagucauggugcaggccgauagugguugcguugugaguuggaaaaacaaagaacugaaaugcggcagugggauuuuuaucacagacaacgugcacacauggacagaacaauacaaauuccaaccagaauccccuucaaagcuggcuucagccauccagaaggcucaugaagaaggcauuuguggaauccgcucaguaacaagacuggagaaucugauguggaaacaaauaacaccagaauugaaucacauucuaucagaaaaugagguaaaguugacuaucaugacaggagacauuaaaggaaucaugcaggcaggaaaacgaucccugcggccucaacccacugagcugaaguacucguggaaaacauggggcaaagcgaaaaugcuuuccacagagcuucauaaccacaccuuucucauugauggccccgaaacagcagaaugucccaacgcaaacagagcuuggaauucacuagaaguugaagacuauggcuuuggaguguucaccacuaacauauggcugaaauugaaagaaaggcaggaugcauuuugugacucaaaacucaugucagcagccauaaaagacaacagagccguucacgccgauauggguuauuggauagaaagcgcacucaacgacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaucauacacaaacggcaggacccuggcaucuagguaggcuugagauggacuuugauuucugcgaaggaaccacagugguggugacugaggauuguggaaauagaggacccuccuuaaggacaacuacugcuucuggaaaacucauaacagaguggugcugccgaucuugcacauuaccaccacuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugauauaggcaugggcgugacuuaucuugcccuguuagcagccuucaaagucagaccaacuuuugcggcuggacuacucuuaagaaagcugaccuccaaggaauugaugaugaccaccauaggaaucacacuccucucucagaguaccauaccagagacuauacuugaacugacugacgcguuggcuuuggggaugaugguucucaaaauagugagaaacauggaaaaguaccaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacucgcguugacgaucaaaggccucaauccaacagccauuuucuuaacaacccucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaaaaaugaagaagaagaacaaacacugaccauacucauuagaacaggacugcuggugauaucaggacuuuuuccugugucaauaccaaucacagcagcugcaugguaccugugggaagugaaaaaacaacgggcaggaguauugugggaugucccuucacccccaccugugggaaaggccgaacuggaagauggagccuauagaaucaagcagaaagggauccuaggauacucgcagauuggagccggaguuuacaaagaaggaacauuccacacaauguggcaugucacacguggugcuguccuaaugcacaaagggaaaagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaaccagcacuggaaccauaggcgccgugucucuggacuuuucuccuggaacgucaggaucuccaaucgucgacaaaaaaggaaaaguugugggccuuuauggcaacggugucgucacaaggaguggaacauaugugagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacgcuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugguauuuucaugacagccaccccuccuggaagcagagacccauuuccucagagcaaugcaccaaucauggaugaagaaagagaaaucccugagcguucguggaacucuggacaugaguggguuacggacuuuaaagggaagacuguuugguuuguuccaaguauaaaagcagggaaugauauagcagcuugccugagaaagaauggaaagaaggugauacaacucagcaggaagacuuuugauuuugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuuuuggauaacaucaacacgccugaaggaaucauucccagcauguucgaaccagaacgugaaaagguggaugccauugauggugaauaccgcuugagaggagaagcgaggaaaacuuuuguggaccuaaugagaagaggagaucuaccagucuggcuagccuacagaguggcagcugaagguaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguagacucccaaccuucaugacccagaaagcaaggaaugcacuggacaacuuagcaguccugcauacggcugaagcaggcggaagggcguacaaucaugcucuuagugaacugccggagacucuggaaacauugcuuuuacuaacacuuuuggccacagucacgggcggaaucuuccuguucuugaugagcggaaaagguguagggaagaugacccugggaaugugcugcauaaucacggcuaguauucuccuaugguaugcacaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaacuauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauaguauugaaaauuccucagugaaugugucucuaacagccauugccaaccaagccacaguguuaaugggucuugggaaaggauggccauuaucaaaaauggacaucggaguuccccuucucgcuaucgggugcuauucacaagucaaccccauaacucucacagcagcccuucucuuauugguagcacauuaugcuaucauagggccaggacuccaagcgaaagcaaccagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaucgguugaaugcauugggaaagagugaauuccagaucuauaagaaaaguggaauccaggaaguagauagaaccuuagcaaaagaaggcaucaaaagaggagaaacagaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacuuugcugugugacauaggggagucgucaccaaacccuacgguugaggcaggacgaacacucagaguucuaaacuuaguggaaaauuggcugaauaacaacacccaauuuugcauaaagguucucaacccauacaugcccucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacaaauggcaaugacagacacgacuccauuuggacaacagcgcgucuucaaagagaaaguggacacaagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaccuccaucuugaaggaaagugugagacauguguguauaacaugaugggaaagagagagaaaaaacuaggggaguucggcaaagcaaaaggcagcagagccauaugguacauguggcuuggagcacgcuucuuagaguucgaagcucuaggauuccugaaugaagaucacugguuuuccagagagaacucccugaguggaguggaaggagaaggacugcacaaacuagguuacauuuuaagagacgugagcaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaucaaaacaagguggugcgugugcaaagaccaacaccaagaggcacaguaauggacauuauaucgagaagagaccaaagagguaguggacaaguugucaccuacggccucaauacuuucacuaacauggaagcccaacugaucagacagauggaaggagaaggagucuucaaaagcauccagcaacugacagucacagaagaaauugcagugaaaaacugguuagugacaguggggcgugagagguuaucaagaauggcuaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccgggugguccuugcgagaaacagccuguuuggggaaguccuacgcccaaauguggagcuugauguacuuccacagacgugaccuuagacuggcggcaaaugccauuugcucggcaguuccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggcuaccugggcaaagaacauccaaacagcaauaaaucaagucagaucccuaauaggcaaugaggaauacacagacuacaugccauccaugaaaagauucagaagagaagaggaagaggcaggagucuugugguag

SEQ ID NO: 7042 - RNA, 9876 nt, Artificial Sequence
  derived and/or modified CDS sequence (wt) from DENV-2__KC762661__SS-prME
acugcagguauaauuaucaugaugaucccaacagugauggcguuccauuuaaccacacgcaauggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacggaaacauggaugucaucagaaggggccuggaaacaugcccagagaauugaaacuugggucuugagacauccaggcuucaccauaauggcagcaauccuggcauauaccauaggaacaacauauuuccaaagaguccugauuuucauuuuacugacagcugucacucccucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacauccugccacucuaaggaaguauuguauagaggcaaagcugaccaacacaacaacagcaucucgcugcccaacacaaggagaaccuagccuaaacgaagaacaggacaaaagguucgucugcaaacacuccaugguagacagaggauggggaaauggaugcggauuauuuggaaagggaggcaucgugaccugugcaauguucacaugcaaaaagaacauggagggaaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaauaaggcuuggcuagugcacaggcaaugguucuuagaccugccguuaccauggcugcccggagcagacacacaaggaucaaauuggauacagaaggagacauuggucacuuucaaaaauccccaugcaaagaaacaggauguuguuguuuuaggaucccaagaaggggcuaugcauacagcacucacaggggccacggaaauccagaugucaucaggaaaccuacuguucacaggacaucuuaagugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggacuuggaaaaaagacauguuuuaggucgcuugauuacagucaacccaauugucacagaaaaagauagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuucggagcuaucuauggggcugccuucagugggguuucauggacuaugaaaauccucauaggagucgucaucacauggauaggaaugaauucacgcagcaccucacugucugugucacuaguauuagugggggucgugacauuguauuugggagucauggugcaggccgauagugguugcguugugaguuggaaaaacaaagaacugaaaugcggcagugggauuuuuaucacagacaacgugcacacauggacagaacaauacaaauuccaaccagaauccccuucaaagcuggcuucagccauccagaaggcucaugaagaaggcauuuguggaauccgcucaguaacaagacuggagaaucugauguggaaacaaauaacaccagaauugaaucacauucuaucagaaaaugagguaaaguugacuaucaugacaggagacauuaaaggaaucaugcaggcaggaaaacgaucccugcggccucaacccacugagcugaaguacucguggaaaacauggggcaaagcgaaaaugcuuuccacagagcuucauaaccacaccuuucucauugauggccccgaaacagcagaaugucccaacgcaaacagagcuuggaauucacuagaaguugaagacuauggcuuuggaguauucaccacuaacauauggcugaaauugaaagaaaggcaggaugcauuuugugacucaaaacucaugucagcagccauaaaagacaacagagccguucacgccgauauggguuauuggauagaaagcgcacucaacgacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaucaaacacaaacggcaggacccuggcaucuagguaggcuugagauggacuuugauuucugcgaaggaaccacagugguggugacugaggauuguggaaauagaggacccuccuuaagaacaacuacugcuucuggaaaacucauaacagaguggugcugccgaucuugcacauuaccaccacuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuacgaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucacacuccucucucagaguaccauaccagagacuauacuugaacugacugacgcguuggcuuuagggaugaugguucucaaaauagugagaaacauggaaaaguaccaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacucgcguugacgaucaaaggccucaauccaacagccauuuucuuaacaacccucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaaaaaugaagaagaagaacaaacacugaccauacucauuagaacaggacugcuggugauaucaggacuuuuuccugugucaauaccaaucacagcagcugcaugguaccugugggaagugaaaaaacaacgggcagggguauugugggaugucccuucacccccaccugugggaaaggccgaacuggaagauggagccuauagaaucaagcagaaagggauccuaggauacucgcagauuggagccggaguuuacaaagaaggaacauuccacacaauguggcaugucacacguggugcuguccuaaugcauaaagggaaaagaauugaaccaucaugggcggacgucaagaaagaccuaauaucguauggaggaggcuggaagcuagaaggagaauggaaggaaggagaagaaguccagguccuggcauuagagccuggaaagaauccaagggccguccaaacaaaacccggucuuuuuaaaaccagcacuggaaccauaggcgccgugucucuggacuuuucuccuggaacgucaggaucuccaaucgucgacaaaaaaggaaaaguugugggccuuuauggcaacggugucgucacaaggaguggaacauaugugagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccaccagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugguauuuucaugacagcuaccccuccuggaagcagagacccauuuccucagagcaaugcaccaaucauggaugaagaaagagaaaucccugagcguucguggaacucuggacaugaguggguuacggacuuuaaagggaagacuguuugguuuguuccaaguauaaaagcagggaaugauauagcagcuugccugagaaagaauggaaagaaggugauacaacucagcaggaagacuuuugauuuugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuuuuggauaacaucaacacgccugaaggaaucauucccagcauguucgaaccagaacgugaaaagguggaugccauugauggugaauaccgcuugagaggagaagcgaggaaaacuuuuguggaccuaaugagaagaggagaucuaccagucuggcuagccuacagaguggcagcugaagguaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaggaaugcacuggacaacuuagcaguucugcauacggcugaagcaggcggaagggcguacaaucaugcucuuagugaacugccggagacucuggaaacauugcuuuuacugacacuuuuggccacagucacgggcggaaucuuccuguucuugaugagcggaaaagguauagggaagaugacccugggaaugugcugcauaaucacggcuaguauucuucuaugguaugcacaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauaguauugaaaauuccucagugaaugugucucuaacagccauugccaaccaagccacaguguuaaugggucuugggaaaggauggccauuaucaaaaauggacaucggaguuccccuucucgcuaucgggugcuauucacaagucaaccccauaacucucacagcagcccuucucuuauugguagcacauuaugcuaucauagggccaggacuccaagcgaaagcaaccagagaggcucagaaaagagcagcagcgggcaucaugaaaaacccaacuguggauggaauaacagugauugaccuagauccaauacccuaugauccaaaguucgaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuauaaugaaaaacacggccaacacaagaaggggaacuggcaacacaggagagacgcuuggagagaaauggaaaaaucgguugaaugcauugggaaagagugaauuccagaucuauaagaaaaguggaauccaggaaguagauagaaccuuagcaaaagaaggcaucaaaagaggagaaacagaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacuuugcugugugacauaggggagucgucaccaaacccuacgguugaggcaggacgaacacucagaguucuaaacuuaguggaaaauuggcugaauaacaacacccaauuuugcauaaagguucucaacccauacaugcccucaguuauagaaaaaauggaagcgcuacaaaggaaauacggaggagcuuuggugaggaauccacucucacgaaauuccacacacgagauguacuggguauccaaugccuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacaaauggcaaugacagacacgaccccauuuggacaacagcgcgucuucaaagagaaaguggacacaagaacccaagaaccgaaagaaggcacgaaaaaauuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaccuccaucuugaaggaaagugugagacauguguguauaacaugaugggaaagagagagaaaaaacuaggggaguucggcaaagcaaaaggcagcagagccauaugguacauguggcuuggagcacgcuucuuagaguucgaagcccuaggauuccugaaugaagaucacugguuuuccagagagaacucccugaguggaguggaaggagaaggacugcacaaacuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacucgcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucacuaacauggaagcccaacugaucagacagauggaaggagaaggagucuucaaaagcauccagcaacugacagucacagaagaaauugcagugaaaaacugguuagugagaguggggcgugagagguuaucaagaauggcuaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccgggugguccuugcgggaaacagccuguuuggggaaguccuacgcccaaauguggagccugauguacuuccacagacgugaccuuagacuggcggcaaaugccauuugcucggcaguuccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggcuaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7043 - RNA, 9876 nt, Artificial Sequence
  derived and/or modified CDS sequence (wt) from DENV-2__KC762655__SS-prME
acugcagguauaauuauuaugaugaucccaacagugauggcguuccauuuaaccacacgcaacggagaaccacacaugaucgucaguagacaagagaaagggaaaagucuucuguuuaaaacagagaacggugugaacauguguacccucauggccauggaccuuggcgaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcauacaccauaggaacaacauauuuccaaagaguccugauuuucauuuuacugacagcugucacucccucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaaaggaggcaucgugaccugugcaauguucacaugcaaaaagaacauggaaggaaaagucgugcaaccagaaaacuuggaguacaccauugugauaacaccucauucaggggaagagaaugcagucggaaaugacacaggaaaacacgguaaggaaauuaaaguaacaccacagaguuccaucacagaagcagaacuaacaggcuauggcacugucacgauggaaugcucuccgagaacgggccucgacuucaaugagauggugcugcugcaaauggaaaacaaggcuuggcuggugcacaggcaaugguucuuagaccugccauuaccauggcugcccggagcagacacacaaggaucaaauuggauacagaaggagacauuggucacuuucaaaaauccccaugcaaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuucgaaauaauggacuuggaaaaaagacaugucuuaggucgcuugauuacagucaacccaauugucacagaaaaagacagcccaguuaacauagaagcagaaccuccauucggagacagcuacaucauuauaggaguagaaccgggacaacugaagcucagcugguuuaagaaaggaaguucuauuggccaaauguuugagacgacaaugagaggagcgaagagaauggccauuuuaggugauacagcuugggauuuuggaucccugggaggaguguucacaucuauaggaaaggcccuccaccaaguuuuuggagcugucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacgugcacacauggacagaacaauacaaauuccaaccagaaucuccuucaaagcuggcuucagcuauccagaaggcucaugaagaaggcauuuguggaauccgcucaguaacaagacuggagaaucugauguggaaacaaauaacaccagaauugaaucacauucuaucagaaaaugagguaaaguugacuaucaugacaggagacauuaaaggaaucaugcaagcaggaaaacgaucccugcggccucaacccacugagcugaaguacucuuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguauuuugugacucaaaacucaugucagcagccauaaaagacaacaaagccguccacgccgauauggguuauuggauagaaagcgcacucaaugacacauggaagauugagaaagccucuuuuauugaaguuaaaagcugccacuggccaaagucacacacccucuggaguaauggagugcuggaaagugagaugauaauuccaaagaauuuugcaggaccagugucacaacacaauuacagaccaggcuaucauacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguauggaauggaaaucagaccauugaaagagaaagaagagaacuuggucaauucuuuggucacagccgggcauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaccuugcccuauuagcagccuucaaagucagaccaacuuuugcggcuggacuacucuuaagaaagcugaccuccaaggaauugaugaugaccaccauaggaaucguacuccucucacagaguaccauaccagagacuauacuugaacugacugaugcguuggcuuuggggaugaugguucucaaaauagugagaaauauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaggaacaggcagagauaucaggaaguaguccaauucugucgauaacaauaucggaagaugguagcaugucgauaaaaaaugaagaagaagaacaaacacugaccauacucaucagaacaggacugcuggugauaucaggacuuuuuccugugucaauaccaaucacggcaacugcaugguaccugugggaagugaaaaaacaacgagcaggaguauugugggaugucccuucacccccaccugugggaaaggccgaacuggaagauggagccuauagaaucaagcagaaagggauccuaggauacucgcagauuggagccggaguuuacaaagaaggaacauuccacacaauguggcaugucacacguggcgcuguccuaaugcauaaagggaagagaauugaaccaucaugggcggacgucaaaaaagaccuaauaucguauggaggaggcuggaagcuagaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgacaaaaaaggaaaaguugugggccuuuauggcaacgguguugucacaaggaguggaacauaugugagugccauagcccagacugaaaaaaguaucgaagacaauccagagauugaagaugacaucuuucgaaagaaaagauugaccaucauggaccuccacccaggagcagggaaaacaaagagauaccuuccagcaauagucagagaggccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaccuaaugugucacgccacauuuaccaugaggcuacuaucaccaauuagagugccaaauuacaaccugauuaucauggaugaagcccauuucacagacccagcaagcauagcagcuagaggauacauuucaacucguguagagaugggugaagcagcugguauuuucaugacagcuaccccuccuggaagcagagacccauuuccucagagcaaugcaccaaucauggaugaagaaagagaaaucccugagcguucguggaacucuggacaugaguggguuacggauuuuaaagggaagacuguuugguuuguuccaaguauaaaagcagggaaugacauagcagcuugccugagaaagaauggaaagaaagugauacaacucagcaggaagacuuuugacuuugaauauaucaagaccaggaccaaugauugggacuuuguagucacgacagacauuucagaaaugggugcuaacuucaaggcugagaggguuauagaccccagacgcugcaugaaaccagucauauuaacagacggugaagagcgggugaucuuggcaggacccaugccagugacccacucuagugcagcacaaagaagagggagaguaggaaggaauccaaaaaaugaaaaugaccaguacauauacaugggggaaccucuggaaaaugaugaagacugugcacacuggaaagaagcuaagaugcuuuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagaucuaccagucuggcuagccuacagaguggcagcugaagguaucaacuacgcagacagaagauggugcuuugauggagucaagaacaaccaaaucuuggaagaaaacguggaaguagaaauuuggacaaaagaaggagaaaggaagaaauuaaaacccagaugguuggaugcuaggaucuacucugacccacuggcgcucaaagaauucaaggaauucgcagccggaagaaagucccugacccugaaucuaaucacagagauggguagacuuccaaccuucaugacccagaaagcaaggaaugcacuggacaauuuagcaguccugcauacggcugaagcaggcggaagggcguacaaucaugcucuuagugaacugccggagacucuggaaacacugcuuuuacugacacuuuuggccacagucacgggcggaaucuucuuguucuugaugagcggaaaggguauagggaagaugacccugggaauguguugcauaaucacggcuaguauucuccuaugguaugcacaaauacagccacacuggauagcagcuucaauaauacuggaguuuuuucucauagucuugcuuauuccagaaccagaaaagcagagaacaccccaagauaaccaguuaacuuauguugucauagccauccuuacagugguggccgcaaccauggcaaacgagauggguuuccuggaaaaaacaaagaaagauuucggauugggaagcauugcaacccagcaaccugaaaguaacauccuggacauagaccuacguccugcaucagcuuggacucuauaugccguggcaacaaccuucaucacaccaauguugaggcauagcauagaaaauuccucagugaaugugucuuuaacagccauugccaaccaagccacaguguuaaugggucuugggaaaggauggccauuaucaaaaauggacaucggaguuccccuucucgcuaucgggugcuauucacaagucaaccccauaacucucacagcagcccuucucuuauugguagcacacuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggcuaacacaagaaggggaacuggcaacacaggagagacgcuuggagagaaauggaaaaaccggcugaaugcauuggggaagagugaauuccagaucuauaagaaaaguggaauccaggaaguggauagaaccuuagcaaaagaaggcauuaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaccuggugcgucuucaaaguggaguugauguuuuuuuuacuccgccagaaaagugugacacacugcugugugacauaggggagucuucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcgcuacaaagaaaauacggaggagcuuuggugaggaauccacucucacgaaauuccacacacgagauguacuggguauccaaugcuuccgggaacauagugucaucagugaacaugauuucaagaauguugauuaacagauuuacaaugagacacaagaaagccacauacgaaccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaagaucacggcagaauggcucuggaaagaacuaggaaagaaaaagacaccuaggaugugcaccagagaagaauucacaagaaaggugagaagcaaugcagcccuaggugccauauucacugaugagaacaaguggaagucggcacgugaggcuguugaagacaguggauuuugggaauuaguugacaaggaaaggagccuccaucuugaaggaaagugugagacauguguguacaacaugaugggaaagagagagaagaaacuaggggaguucggcaaagcaaaaggcagcagggccauaugguacauguggcuuggagcacgcuucuuagaguuugaagcucuaggauucuugaaugaagaucacugguuuuccagagagaacucccugaguggaguggaaggagaagggcugcacaaacuaggcuacauuuuaagagacguaaguaagaaagaaggaggagcaauguaugccgaugacaccgcaggaugggacacaagaaucacacuagaggacuuaaagaaugaagaaauggugacaaaccacauggaaggagaacacaagaaacuugcugaagccauuuucaaauuaacguaccaaaacaagguggugcgugugcaaagaccaacaccaagaggcauaguaauggacauuauaucgagaagagaccaaagagguaguggacaaguugucacguacggccucaauacuuucaccaacauggaagcccaacugaucagacagauggagggagaaggagucuucaaaagcauccagcaacugacagucacagaagaaauugcagugaaaaauugguuagcaagaguggggcgugagagguugucaagaauggccaucaguggagaugauuguguugugaaacccuuagaugacagguuugcaagugcucuaacagcucuaaaugacaugggaaaggucaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccgggugguccuugcgggaaacagccuguuuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggcuaccugggcaaggaacauccaaacagcaauaaaucaaguuagaucccuaauaggcaaugaggaauacacagacuacaugccauccaugaaaagauucagaagagaagaggaagaggcaggagucuugugguag

SEQ ID NO: 7044 - RNA, 9876 nt, Artificial Sequence
  derived and/or modified CDS sequence (wt) from DENV-2__KC762656__SS-prME
acugcagguauaauuauuaugaugaucccaacagugauggcguuccauuuaaccacacgcaacggagagccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacacgugggaaugggacuggagacacgagcugaaacauggaugucaucagaaggggccuggaaacaugcccagagaauugaaacuugggucuugagacauccaggcuucaccauaauggcagcaauccuggcauacaccauaggaacaacauauuuccaaagaguccugaucuucauuuuacugacagcugucacucccucaaugacaaugcguuguauaggaauaucaaacagagacuuuguggaagggguuucaggagggagcuggguugacauagucuuggaacauggaagcugugugacgacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcauugugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacagacaaugguucuuagaccugccguuaccauggcugcccggagcagacacacaaggaucaaauuggauacagaaggagacauuggucacuuucaaaaauccccaugcaaagaaacaggauguuguuguuuuaggaucccaagaaggggcuaugcauacagcacucacaggggccacggaaauccagaugucaucaggaaacuuacuguucacagggcaucuuaagugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuucgaaauaauggacuuggaaaaaagacaugucuuaggucgcuugauuacagucaacccaauugucacagaaaaagacagcccagucaacauagaagcagaaccuccauucggagacagcuacaucauuauaggaguagaaccgggacaacugaaacucagcugguuuaagaaaggaaguucuauuggccaaauguuugagacgacaaugagaggagcgaagagaauggccauuuuaggugauacagcuugggauuuuggaucccugggaggaguguucacaucuauaggaaaggcccuccaccaaguuuuuggaacuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacgugcacacauggacagaacaauacaaauuccaaccagaaucccccucaaagcuggcuucagcuauccagaaggcucaugaagaaggcauuuguggaauccgcucaguaacaagacuggagaaucugauguggaaacaaauaacaccagaauugaaucacauucuaucagaaaaugagguaaaguugacuaucaugacaggagacauuaaaggaaucaugcaagcaggaaaacgaucccugcggccucaacccacugagcugaaguacucuuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguauuuugugacucaaaacucaugucagcagccauaaaagacaacagagccguccacgccgauauggguuauuggauagaaagcgcacucaaugacacauggaagauugagaaagccucuuuuauugaaguuaaaagcugccaauggccaaagucacacacucucuggaguaauggagugcuggaaagugagaugauaauuccaaagaauuuugcaggaccagugucacaacacaauuacagaccaggcuaucauacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagauacagaggugaggauggaugcugguauggaauggaaaucagaccauugaaagagaaagaagagaacuuggucaauucuuuggucacagccgggcauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauuaaugaugaccaccauaggaaucguacuccucucacagaguaccauaccagagacuauacuugaacugacugaugcauuggcuuugggaaugaugguucucaaaauagugagaaauauggaaaaguaucaacuagcagugacuaucauggccaucuugugcgucccaaaugcagugauauuacaaaacgcauggaaagugaguugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauucuagccaguucucucuuaaagaaugauauucccaugacaggaccacuaguggcuggagggcuucucacuguguguuacgugcucacuggaagaucggcugauuuggaacuggaaagagcugcugacguaagaugggaagaacaggcagaaauaucaggaaguaguccaauucugucaauaacaauaucggaagaugguagcaugucgauaaaaaaugaagaagaagaacaaacacugaccauacucaucagaacaggacugcuggugguaucaggacucuuuccuguaucaauaccaaucacggcagcugcaugguaccugugggaagugaaaaaacaacgagcaggaguauugugggaugucccuucacccccaccugugggaaaggccgaacuggaagauggagccuauagaaucaagcagaaagggauccuaggauacucgcagauuggagccggaguuuacaaagaaggaacauuccacacaauguggcaugucacacguggugcuguacuaaugcauaaagggaagagaauugaaccaucaugggcggacgucaaaaaagaccuaauaucguauggaggaggcuggaagcuagaaggagaauggaaggaaggagaagaaguccagguccuggcauuagagccuggaaagaacccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacgguguugucacaaggaguggaacauaugugagugccauagcccagacugaaaaaaguaucgaagacaauccagagauugaagaugacaucuuucgaaagaaaagauugaccaucauggaccuccacccaggagcagggaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugaucaucauggaugaagcccauuucacagacccagcaagcauagcagcuagaggauacauuucaacucgaguagagaugggugaagcagcugguauuuucaugacagcuaccccuccuggaagcagagacccauuuccucagaguaaugcaccaaucauggacgaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaagacuuuugauuuugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuuuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagaucuaccagucuggcuagccuacagaguggcagcugaagguaucaacuacgcagacagaagauggugcuuugauggagucaagaacaaucaaaucuuggaagagaauguggaaguagaaauuuggacaaaagaaggagaaaggaagaaauuaaaacccagaugguuggaugcuaggaucuacucugacccacuggcgcucaaagaauucaaggaauucgcagcuggaagaaaaucccugacccugaaucuaaucacagagauggguagacucccaaccuucaugacccagaaagcaaggaaugcacuggacaacuuagcaguccugcauacggcugaagcaggcggaagggcguacaaucaugcucuuagugaacugccggagacucuggaaacauugcuuuuacugacacuuuuggccacagucacgggcggaaucuuccuguucuugaugagcggaaaggguauagggaagaugacccugggaaugugcugcauaaucacggcuagcauucuccuaugguaugcgcaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaaccauggcaaacgagauggguuuucuggaaaaaacaaagaaagauuucggauugggaagcauugcaacccagcaaccugagaguaacauccuggacauagaucuacguccugcaucagcuuggacucuauaugccguggcgacaacuuucaucacaccaauguugaggcauagcauagaaaauuccucggugaaugugucucuaacagccauugccaaccaagccacaguguuaaugggucuugggaaaggauggccauuaucaaaaauggacaucggaguuccccuccucgcuaucgggugcuauucacaagucaaccccauaacucucacagcagcccuucucuuauugguagcacacuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcaguaucaauggcuaacauuuuuagagggaguuaccuggccggagccggacuucucuuuuccaucaugaaaaacacggccaacacaagaaggggaacuggcaacacaggagagacgcuuggagagaaauggaaaaaccgguugaaugcauuggggaagagugaauuccagaucuacaagaaaaguggaauccaggaaguggauagaaccuuagcaaaagaaggcauuaaaagaggagaaacggaccaucacgcugugucgcgaggcucagcgaagcugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacauugcugugugacauaggggagucgucaccaaaccccacgguugaggcaggacgaacacucagaguucuaaacuuaguggaaaauuggcugaacaacaacacccaauuuugcauaaagguccucaacccauacaugcccucaguuauagaaaaaauggaagcguuacaaaggaaauacggaggagcuuuggugaggaauccacucucacgaaauuccacacacgagauguacuggguauccaaugccuccgggaacauagugucaucagugaacaugauuucaagaauguugauuaacagauucacaaugagacacaagaaagccacauacgaaccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacgaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggcgccauauucacugaugagaacaaguggaagucggcacgugaggcuguugaagacaguggauuuugggaauugguugacaaggaaaggaaccuccaucuugaaggaaagugugagacauguguauacaacaugaugggaaagagagagaagaagcuaggggaguucggcaaagcaaaaggcagcagggccauaugguacauguggcuuggagcacgcuucuuagaguuugaagcucuaggauucuugaaugaagaucacugguuuuccagagagaacucccugaguggaguggaaggagaagggcugcacaaacuaggcuacauuuuaagagacgugaguaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaacugacagucacagaagaaaucgcagugaaaaacugguuaguaagaguggggcgugagagguugucaagaauggccaucaguggagaugauuguguugugaaacccuuagaugacagguuugcaagugcucuaacagcucuaaaugacaugggaaagguuaggaaagacauacaacaaugggaaccuucaagaggauggaacgacuggacacaagugccuuuuuguucacaccauuuccaugagcuaaucaugaaggacggucguguacucguaguuccaugcagaaaccaagaugaacugauugguagggcccgaauuucccagggagccgggugguccuugcgggaaacagccuguuuggggaaguccuacgcccaaauguggagccugauguacuuccacagacgugaccuuaggcuggcggcaaaugcuauuugcucggcagucccaucacauuggguuccaacaagucgaacaaccugguccauacacgccacacaugaguggaugacaacagaagauauguugacagucuggaacaggguguggauucaagaaaacccauggauggaagacaaaacuccaguagaaucaugggaggaaaucccguauuuggggaaaagagaagaccaauggugcggcucauugauugggcuaacaagcagggcuaccugggcaaagaacauccaaacagcaauuaaucaaguuagaucccuaauaggcaaugaggaauacacagacuacaugccauccaugaaaagauucagaagagaagaggaagaggcaggagucuugugguag

SEQ ID NO: 7045 - RNA, 9876 nt, Artificial Sequence
  derived and/or modified CDS sequence (wt) from DENV-2__KC762673__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacucucauggccauggaccuuggugaacugugugaagacacaaucacuuauaauuguccucuccucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcuuacacuauaggaacgacacauuuccaaagaguccugaucuucaucuuacugacagcugucgcuccuucaaugacaaugcguugcauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaagggaaaauugugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuaugguacuguuacgauggaaugcucuccgagaacgggccucgacuucaaugagaugguguugcugcaaauggaaaacaaagcuuggcuggugcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggcuaugcacacagcacucacaggggccacagaaauccagaugucaucaggaaacuuacuguucacuggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccauguaagaucccuuuugaaauaauggauuuggaaaaaagacauguccuaggucgcuugauuacagucaacccaauugucacagaaaaagacagcccagucaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuugggaggaguguucacauccauaggaaaggcccuccaccaagucuuuggagcaaucuauggggcugccuucagugggguuucauggacuaugaaaauccucauaggagucgucaucacauggauaggaaugaauucacgcagcacuccacugucugugucacuaguauuagugggggucgugacauuguauuugggaguuauggugcaggcugauagugguugcguugugaguuggaaaaacaaagaacugaaauguggcagugggauuuuuaucacagacaacguacacacauggacagaacaauacaaauuccaaccagaauccccuucaaagcuggccucagcuauccagaaggcucacgaagaaggcauuuguggaauccgcucaguaacaagacuggagaaucugauguggaaacaaauaacaccagaacugaaucacauucuaucagaaaaugaggugaaguugacuaucaugacaggagacauuaaaggaaucaugcaggcaggaaaacgaucccugcggccucaacccacugagcugaaguacucuuggaaaacauggggcaaagcgaaaaugcucuccacagagcuucacaaccacaccuuucucauugauggccccgaaacagcagaaugucccaacacaaacagagcuuggaacucacuagaagucgaagacuauggcuuuggaguauucaccaccaacauauggcugaaauugaaagaaaggcaggauguauauugugacucaaaacucaugucagcagccauaaaagauaacagagccguccacgcugauauggguuauuggauagaaagcgcacucaaugacacauggaagauugagaaagccucuuuuauugaaguuaaaagcugcuacuggccaaagucacacacccucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaaccacagugguggugacugaggacuguggaaauagaggacccucuuuaagaacaacuacugcuucuggaaaacucauaacagaguggugcugccgaucuugcacauuaccaccacuaagguacagaggugaggauggaugcugguauggaauggaaauuagaccacugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucucgcccuauuagcagccuucaaagucagaccaacuuuugcagcuggauuacucuuaagaaagcugaccuccaaggaauugaugaugaccaccauaggaaucgugcuccucucccagagcaccauaccagagacuauacuugaacugacugacgcauuggcuuuggggaugauggcucucaaaauagugagaaacauggaaaaguaucaacuagcagugacuaucauggccaucuugugcguuccaaaugcagugauauuacaaaacgcauggaaagugagcugcacaacacuggcagugguguccguuuccccacugcuuuuaacauccucacagcagaaagcggauuggauaccacuggcguugacgaucaaaggccuuaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacguacucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuagugauaucaggacuuuuucccgugucaauaccaaucacggcagcugcaugguaccugugggaagugaaaaaacaacgagcaggaguauugugggauguccccucacccccaccugugggaaaggccgaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaaguuagaaggagaauggaaagaaggagaagaaguccagguccuggcauuagagccuggaaagaauccaagagcuguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaacggugucguuacaaggaguggaacauaugugagugcuauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaucaaaccccagcuaucaaagcugagcacacugggcgggagauuguggaucuaaugugucacgccacauuuaccaugaggcuacuaucaccaauuagagugccaaauuacaacuugauuaucauggaugaagcccauuuuacagacccagcaagcauagcagcuagaggauacauuucaacucgaguagagaugggugaagcagcugggauuuucaugacagcuaccccuccuggaaguagagacccauuuccucagagcaaugcaccaaucauggaugaagaaagggaaaucccugagcguucguggaacucuggacaugaauggguuacggauuuuaaagggaagacuguuugguuuguuccaagcauaaaagcagggaaugauauagcagcuugccugagaaagaauggaaagaaagugauacaacucagcaggaagacuuuugauuuugaauauauuaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccccuggaaaaugaugaagacugugcacacuggaaagaagcuaaaaugcuucuagacaacaucaacacgccugaaggaaucauucccagcauguucgaaccagagcgugaaaagguggaugccauugauggugaauaccgcuugagaggagaagcaagaaaaacuuuuguggaccuaaugagaagaggagaccuaccagucugguuagccuacagaguggcagcugaagguaucaacuacgcagacagaagaugguguuuugauggagucaagaacaaccaaaucuuggaagaaaauguggaaguggaaauuuggacaaaagaaggagaaaggaagaaauugaaacccagaugguuggaugcuaggaucuauucugacccacuggcgcucaaagaauucaaggaauucgcagcuggaagaaagucccugacccugaaucuaaucacagagauggguaggcucccaaccuucaugacccagaaagcaaggaaugcacuggacaacuuagcagucuugcauacagcugaagcaggcggaagggcguacaaccaugcucuuagugaacugccggagacucuggagacauugcuuuuacugacacucuuggccacagucacgggcggaaucuuccuguucuugaugaguggaaaggguauagggaagaugacccugggaaugugcugcauaaucacggccaguauucuccuaugguaugcacaaauacagccacacuggauagcagcuucaauaauauuggaguuuuuucucauagucuugcucauuccagaaccagaaaagcagagaacaccccaagauaaccaauuaacuuauguugucauagccauccuuacagugguggccgcaaccauggcaaaugagauggguuuccuggaaaaaacaaagaaagauuucggauugggaagcauuacaacccagcaaccugagagcaauauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacauaggaguuccccuucucgcuaucgggugcuauucacaagucaaccccauaacucucacagcagcccuucucuuauugguagcacauuaugcuaucauagggccaggacuccaagcgaaagcaacuagagaggcucaaaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccaggaagauucuggaauacaacuauugcagugucaauggcuaacauuuuuagagggaguuacuuggccggagccggacuucucuuuucuaucaugaagaacacggcuaacacaagaaggggaacuggcaacacaggagagacgcuuggagagaaauggaaaaaccgguugaaugcauuggggaagagugaauuccagaucuauaagaaaaguggaauccaggaaguggauagaaccuuggcaaaagaaggcaucaaaagaggagaaacagaccaucacgcugugucgcgaggcucggcgaaacugagaugguucgucgagagaaaccuggucacaccagaagggaaaguaguggaccuugguugcggcagggggggcuggucauacuauugugggggacuaaagaauguaaaagaagucaaaggccuaacaaaaggaggaccaggacacgaagaacccauucccaugucaacauauggcuggaaucuggugcgucuucaaaguggaguugauguuuuuuuuacuccgccagaaaagugugauacauugcugugugacauaggggagucgucaccaaaccccacgguugaagcaggacgaacucucagaguucuaaacuuaguggaaaauuggcugaacaacaacacccaauuuugcauaaagguucucaacccauauaugcccucaguuauagaaaaaauggaagcgcuacaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagauguugaccucggaaguggaacccgcaacaucggaauugaaagugagauaccaaauuuagacauaauugggaaaagaauagaaaaaauaaaacaagagcaugaaacaucauggcauuaugaccaagaucacccauacagaacgugggccuaucauggcagcuacgaaacaaaacagacuggaucagcaucauccauggugaacggagugguuagguugcuaacaaaaccuugggacguuaucccuauggugacacagauggcaaugacagauacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaaguaaugcagccuuaggcgccauauucacugaugagaacaaguggaagucggcacgugaggcuguugaagacaguggauuuugggaauugguugacaaggaaaggaaucuccaucuugaaggaaagugugagacauguguauauaacaugaugggaaagagagagaagaagcuaggggaguucggcaaagcgaaaggcagcagagccauaugguacauguggcuuggagcacgcuucuuagaguuugaagcccuaggauucuugaacgaagaucacugguuuuccagagagaacucccugaguggaguggaaggagaagggcugcacaaacuaggcuacauuuuaagagacgugaguaagaaagaaggaggggcaauguacgcugaugacaccgcaggaugggacacaagaaucacauuagaggacuuaaaaaacgaagaaauggugacaaaccacauggaaggagaacacaagaaacuugcugaagccaucuucaaauuaacguaccaaaacaagguggugcgugugcaaagaccaacgccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcaauugacagucacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugccuuuuuguucacaccauuuccaugaguuaaucaugaaggacggucguguacucguaguuccaugcagaaaucaagaugaacugauugguagggcccgaauuucccagggagccgggugguccuugcgggaaacagccuguuuggggaagucuuacgcccaaauguggagccugauguacuuccacagacgugaccuuaggcuagcagcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaagaggaagaggcaggagucuugugguag

SEQ ID NO: 7046 - RNA, 9876 nt, Artificial Sequence
  derived and/or modified CDS sequence (wt) from DENV-2__KC762663__SS-prME
acugcagguauaauuaucaugaugaucccaacagugauggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacggaaacauggaugucaucagaaggggccuggaaacaugcccagagaauugaaacuugggucuugagacauccaggcuucaccauaauggcagcaauccuggcauauaccauaggaacaacauauuuccaaagaguccugauuuucauuuuacugacagcugucacucccucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacauccugccacucuaaggaaguauuguauagaggcaaagcugaccaacacaacaacagcaucucgcugcccaacacaaggagaaccuagccuaaacgaagaacaggacaaaagguucgucugcaaacacuccaugguagacagaggauggggaaauggaugcggauuauuuggaaagggaggcaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagagcuaacaggcuauggcacugucacgauggaaugcucuccgagaacgggccucgacuucaaugagaugguguugcugcaaauggaaaauaaggcuuggcuggugcacaggcaaugguucuuagaccugccguuaccauggcugcccggagcagacacacaaggaucaaauuggauacagaaggagacacuggucacuuucaaaaacccccaugcaaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaacggacuuggaaaaaagacauguuuuaggucgcuugauuacagucaacccaauugucacagaaaaagauagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaaaagaauggccauuuuaggugacacagcuugggauuuuggaucccugggaggaguguucacaucuauaggaaaggcccuccaccaagucuucggagcuaucuauggggcugccuucagugggguuucauggacuaugaaaauccucauaggagucgucaucacauggauaggaaugaauucacgcagcaccucacugucugugucacuaguauuagugggggucgugacauuguauuugggagucauggugcaggccgauagugguugcguugugaguuggaaaaacaaagaacugaaaugcggcagugggauuuuuaucacagacaacgugcacacauggacagaacaauacaaauuccaaccagaauccccuucaaagcuggcuucagccauccagaaggcucaugaagagggcauuuguggaauccgcucaguaacaagacuggagaaucugauguggaaacaaauaacaccagaauugaaucacauucuaucagaaaaugagguaaaguugacuaucaugacaggagacauuaaaggaaucaugcaggcaggaaaacgaucccugcggccucaacccacugagcugaaguacucguggaaaacauggggcaaagcgaaaaugcuuuccacagagcuucauaaccacaccuuucucauugauggccccgaaacagcagaaugucccaacgcaaacagagcuuggaauucacuagaaguugaagacuauggcuuuggaguguucaccacuaacauauggcugaaauugaaagaaaggcaggaugcauuuugugacucaaaacucaugucagcagccauaaaagacaacagagccguucacgccgauauggguuauuggauagaaagugcacucaacgacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaucauacacaaacggcaggacccuggcaucuagguaggcuugagauggacuuugauuucugcgaaggaaccacagugguagugacugaggauuguggaaauagaggacccuccuuaagaacaacuacugcuucuggaaaacucauaacagaguggugcugccgaucuugcacauuaccaccacuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugauauaggcaugggcgugacuuaucuugcccuguuagcagccuucaaagucagaccaacuuuugcggcuggacuacucuuaagaaagcugaccuccaaggaauugaugaugaccaccauaggaaucacacuccucucucagaguaccauaccagagacuauacuugaacugacugacgcguuggcuuuggggaugaugguucucaaaauagugagaaacauggaaaaguaccaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacucgcguugacgaucaaaggccucaauccaacagccauuuucuuaacaacccucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaaaaaugaagaagaagaacaaacacugaccauacucauuagaacaggacugcuggugauaucaggacuuuuuccugugucaauaccaaucacagcagcugcaugguaccugugggaagugaaaaaacaacgggcaggaguauugugggaugucccuucacccccaccuguggaaaaggccgaacuggaagauggagccuauagaaucaagcagaaagggauccuaggauacucgcagauuggagccggaguuuacaaagaaggaacauuccacacaauguggcaugucacacguggugcuguccuaaugcacaaagggaaaagaauugaaccaucaugggcggacgucaagaaagaccuaauaucguauggaggaggcuggaagcuagaaggagaauggaaggaaggagaagagguccagguccuggcauuagagccuggaaagaauccaagggccguccaaacaaaacccggucuuuuuaaaaccagcacuggaaccauaggcgccgugucucuggacuuuucuccuggaacgucaggaucuccaaucgucgacaaaaaaggaaaaguugugggccuuuauggcaacggugucgucacaaggaguggaacauaugugagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacgcuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugguauuuucaugacagccaccccuccuggaagcagagacccauuuccucagagcaaugcaccaaucauggaugaagaaagagaaaucccugagcguucguggaacucuggacaugaguggguuacggacuuuaaagggaagacuguuugguuuguuccaaguauaaaagcagggaaugauauagcagcuugccugagaaagaauggaaagaaggugauacaacucagcaggaagacuuuugauuuugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuuuuggauaacaucaacacgccugaaggaaucauucccagcauguucgaaccagaacgugaaaagguggaugccauugauggugaguaccgcuugagaggagaagcgaggaaaacuuuuguggaccuaaugagaagaggagaucuaccagucuggcuagccuacagaguggcagcugaagguaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguagacucccaaccuucaugacccagaaagcaagaaaugcacuggacaacuuagcaguccugcauacggcugaagcaggcggaagggcguacaaucaugcucuuagugaacugccggagacucuggaaacauugcuuuuacugacacuuuuggccacagucacgggcggaaucuuccuguucuugaugagcggaaaagguauagggaagaugacccugggaaugugcugcauaaucacggcuaguauucuccuaugguaugcacaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaacuauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauaguauugaaaauuccucagugaaugugucucuaacagccauugccaaccaagccacaguguuaaugggucuugggaaaggauggccauuaucaaaaauggacaucggaguuccccuucucgcuaucgggugcuauucacaagucaaccccauaacucucacagcagcccuucucuuauugguagcacauuaugcuaucauagggccaggacuccaagcgaaagcaaccagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaucgguugaaugcauugggaaagagugaauuccagaucuauaagaaaaguggaauccaggaaguagauagaaccuuagcaaaagaaggcaucaaaagaggagaaacagaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacuuugcugugugacauaggggagucgucaccaaacccuacgguugaggcaggacgaacacucagaguucuaaacuuaguggaaaauuggcugaauaacaacacccaauuuugcauaaagguucucaacccauacaugcccucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacaaauggcaaugacagacacgacuccauuuggacaacagcgugucuucaaagagaaaguggacacaagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaccuccaucuugaaggaaagugugagacauguguguauaacaugaugggaaagagagagaaaaaacuaggggaguucggcaaagcaaaaggcagcagagccauaugguacauguggcuuggagcacgcuucuuagaguucgaagcucuaggauuccugaaugaagaucacugguuuuccagagagaacucccugaguggaguggaaggagaaggacugcacaaacuagguuacauuuuaagagacgugagcaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucacuaacauggaagcccaacugaucagacagauggaaggagaaggagucuucaaaagcauccagcaacugacagucacagaagaaauugcagugaaaaacugguuagugacaguggggcgugagagguuaucaagaauggcuaucaguggagaugauuguguugugaaacccuuggaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccgggugguccuugcgagaaacagccuguuuggggaaguccuacgcccaaauguggagccugauguacuuccacagacgugaccuuagacuggcggcaaaugccauuugcucggcaguuccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggcuaccugggcaaagaacauccaaacagcaauaaaucaagucagaucccuaauaggcaaugaggaauacacagacuacaugccauccaugaaaagauucagaagagaagaggaagaggcaggagucuugugguag

SEQ ID NO: 7047 - RNA, 9876 nt, Artificial Sequence
  derived and/or modified CDS sequence (wt) from DENV-2__KC762675__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacucucauggccauggaccuuggugaacugugugaagacacaaucacuuauaauuguccucuccucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcuuacacuauaggaacgacacauuuccaaagaguccugaucuucaucuuacugacagcugucgcuccuucaaugacaaugcguugcauaggaauaucaaauagagacuucguggaagggguuucaggaggaagcuggguugacauagucuuggaacauggaagcugugugacgacgauggcgaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaagggaaaauugugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuaugguacuguuacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggcuaugcacacagcacucacaggggccacggaaauccagaugucaucaggaaacuuacuguucacuggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccauguaagaucccuuuugaaauaauggauuuggaaaaaagacauguccuaggucgcuugauuacagucaacccaauugucacagaaaaagacagcccagucaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuugggagggguguucacauccauaggaaaggcccuccaccaagucuuuggagcaaucuauggggcugccuucagugggguuucauggacuaugaaaauccucauaggagucgucaucacauggauaggaaugaauucacgcagcacuucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggccucagcuauccagaaggcucacgaagaaggcauuuguggaauccgcucaguaacaagacuggagaaucugauguggaaacaaauaacaccagaacugaaucacauucuaucagaaaaugaggugaaguugacuaucaugacaggagacauuaaaggaaucaugcaggcaggaaaacgaucccugcggccucaacccacugagcugaaguacucuuggaaaacauggggcaaagcgaaaaugcucuccacagagcuucacaaccacaccuuucucauugauggccccgaaacagcagaaugucccaacacaaacagagcuuggaacucacuagaagucgaagacuauggcuuuggaguauucaccaccaacauauggcugaaauugaaagaaaggcaggauguauauugugacucaaaacucaugucagcagccauaaaagauaacagagccguccacgccgauauggguuauuggauagaaagcgcacucaaugacacauggaagauugagaaagccucuuuuauugaaguuaaaagcugcuacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaaccacagugguggugacugaggacuguggaaauagaggacccucuuuaagaacaacuacugcuucuggaaaacucauaacagaguggugcugccgaucuugcacauuaccaccacuaagguacagaggugaggauggaugcugguauggaauggaaauuagaccacugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggauuacucuuaagaaagcugaccuccaaggaauugaugaugaccaccauaggaaucgugcuccucucccagagcaccauaccagagacuauacuugaacugacugacgcauuggcuuuggggaugauggcucucaaaauagugagaaacauggaaaaguaucaacuagcagugacuaucauggccaucuugugcguuccaaaugcagugauauuacaaaaugcauggaaagugagcugcacaacacuggcagugguguccguuuccccacugcuuuuaacauccucacagcagaaagcggauuggauaccacuggcguugacgaucaaaggccuuaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacguacucacuggaagaucggcugauuuggaacuggagagagcugcugacguaagaugggaagaacaggcagagauaucaggaaguaguccaauccugucgauaacaauaucggaagaugguagcaugucgauaaaaaaugaagaagaagaacaaacacugaccauacucaucagaacaggacuguuagugauaucaggacuuuuucccgugucaauaccaaucacggcagcugcaugguaccugugggaagugaaaaaacaacgagcaggaguauugugggauguccccucacccccaccugugggaaaggccgaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaaguuagaaggagaauggaaagaaggagaagaaguccagguccuggcauuagagccuggaaagaauccaagagcuguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaacggugucguuacaaggaguggaacauaugugagugcuauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaauuugauuaucauggaugaagcccauuucacagacccagcaagcauagcagcuagaggauacauuucaacucgaguagagaugggugaagcagcugggauuuucaugacagcuaccccuccuggaaguagagacccauuuccucagagcaaugcaccaaucauggaugaagaaagggaaaucccugagcguucguggaacucuggacaugaauggguuacggauuuuaaagggaagacuguuugguuuguuccaagcauaaaagcagggaaugauauagcagcuugccugagaaagaauggaaagaaagugauacaacucagcaggaagacuuuugauuuugaauauauuaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaaaaugcuucuagacaacaucaacacgccugaaggaaucauucccagcauguucgaaccagagcgugaaaagguggaugccauugauggugaauaccgcuugagaggagaagcaagaaaaacuuuuguggaccuaaugagaagaggagaccuaccagucugguuagcuuacagaguggcagcugaagguaucaacuacgcagacagaagauggugcuuugauggagucaagaacaaccaaaucuuggaagaaaauguggaaguggaaauuuggacaaaagaaggagaaaggaagaaauugaaacccagaugguuggaugcuaggaucuauucugacccacuggcgcucaaagaauucaaggaauucgcagcuggaagaaagucccugacccugaaucuaaucacagagauggguaggcucccaaccuucaugacccagaaagcaaggaaugcacuggacaacuuagcagucuugcauacagcugaagcaggcggaagggcguacaaucaugcucuuagugaacugccggagacucuggagacauugcuuuuacugacacucuuggccacagucacgggcggaaucuuccuguucuugaugaguggaaaggguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaaugagauggguuuccuggaaaaaacaaagaaagauuucggauugggaagcauuacaacccagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacagcagcccuucucuuauugguagcacauuaugcuaucauagggccaggacuccaagcgaaagcaacuagagaggcucaaaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccaggaagauucuggaauacaacuauugcagugucaauggcuaacauuuuuagagggaguuacuuggccggagccggacuucucuuuucuaucaugaagaacacggcuaacacaagaaggggaacuggcaacacaggagagacgcuuggagagaaauggaaaaaccgguugaaugcauuggggaagagugaauuccagaucuauaagaaaaguggaauccaggagguggauagaaccuuggcaaaagaaggcaucaaaagaggagaaacagaccaucaugcugugucgcgaggcucggcgaaacugagaugguucgucgagagaaaccuggucacaccagaagggaaaguaguggaccuugguugcggcagggggggcuggucauacuauugugggggacuaaagaauguaaaagaagucaaaggccuaacaaaaggaggaccaggacacgaagaacccauucccaugucaacauauggcuggaaucuggugcgucuucaaaguggaguugauguuuuuuucacuccgccagaaaagugugauacauugcugugugacauaggggagucgucaccaaaccccacgguugaagcaggacgaacucucagaguucuaaacuuaguggaaaauuggcugaacaacaacacccaauuuugcauaaagguucucaacccauauaugcccucaguuauagaaaaaauggaagcacuacaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagauguugaccucggaaguggaacccgcaacaucggaauugaaagugagauaccaaauuuagacauaauugggaaaagaauagaaaaaauacaacaagagcaugaaacaucauggcauuaugaccaagaucacccauacagaacgugggccuaucauggcagcuacgaaacaaaacagacuggaucagcaucauccauggugaacggagugguuagguugcuaacaaaaccuugggacguuaucccuauggugacacagauggcaaugacagauacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaaguaaugcagccuuaggcgccauauucacugaugagaacaaguggaagucggcacgugaggcuguugaagacaguggauuuugggaauugguugacaaggaaaggaaucuccaucuugaaggaaagugugagacauguguauauaacaugaugggaaagagagagaagaagcuaggggaguucggcaaagcgaaaggcagcagagccauaugguacauguggcuuggagcacgcuucuuagaguuugaagcccuaggauucuugaacgaagaucacugguuuuccagagagaauucccugaguggaguggaaggagaagggcugcacaaacuaggcuacauuuuaagagacgugaguaagaaagaaggaggagcaauguacgcugaugacaccgcaggaugggacacaagaaucacauuagaggacuuaaaaaaagaagaaauggugacaaaccacauggaaggagaacacaagaaacuugcugaagccaucuucaaauuaacguaccaaaacaagguggugcgugugcaaagaccaacgccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcaauugacagucacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugccuuuuuguucacaccauuuccaugaguuaaucaugaaggacggucguguacucguaguuccaugcagaaaucaagaugaacugauugguagggcccgaauuucccagggagccgggugguccuugcgggaaacagccuguuuggggaagucuuacgcccaaauguggagccugauguacuuccacagacgugaccuuaggcuggcagcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaauuccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagggaagaggaagaggcaggagucuugugguag

SEQ ID NO: 7048 - RNA, 9876 nt, Artificial Sequence
  derived and/or modified CDS sequence (wt) from DENV-2__KC762671__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacugcuggugcaacucuacgucuacauggguaacuuacgggacaugcaccgccacaggagaacacagaagggaaaaaagaucaguggcacucguuccacaugugggaaugggacuggagacacgaacugaaacauggaugucaucagaaggggccuggaaacaugcccagagaauugaaacgugggucuugagacauccaggcuucaccauaauggcagcaauccuggcuuacaccauaggaacgacauauuuccaaagaguccugaucuucaucuuacugacagcugucgcuccuucaaugacaaugcguuguauaggaauaucaaauagagacuuuguggaagggguaucaggaggaagcuggguugacauagucuuggaacauggaagcugugugacgacgauggcaaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggagguaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacgguaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggccaugcacacagcacucacaggggccacggaaauccagaugucaucaggaaacuugcuguucacaggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaauugucacagaaaaagacagcccagucaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuugggagggguguucacauccauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuagagaaucugauguggaaacaaauaacaccagaacugaaucacauucuaucagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuccucauugauggccccgaaacagcagaaugucccaacacaaacagagcuuggaacucacuagaaguugaagacuauggcuuuggaguauuuaccaccaacauauggcugaaauugaaagaaaggcaggauguauuuugugacucaaaacucaugucagcagccauaaaagacagcagagccguccacgccgauauggguuauuggauagaaagcgcacucaacgacacauggaagauugagaaagccucuuuuauugaaguuaaaagcugccacuggccaaagucacacacucucuggaguaauggagugcuagaaagugagaugauaauuccaaagaacuuugcaggaccagugucacaacacaauuacagaccaggcuaucauacacaaacggcaggacccuggcaucuaggcaggcuugagauggacuucgauuucugcgaaggaaccacagugguggugacugaggacuguggaaauagaggaccuucuuuaagaacaacuacugcuucuggaaaacucauaacagagugguguugccgaucuugcacauuaccaccgcuaagguacagaggugaggauggaugcugguauggaauggaaauuagaccauugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaaucgugcuccucucccaggccaccauaccagagacuauacuugaacugacugacgcguuggcuuuggggaugaugguucucaaaauagugagaaacauggaaaaguaucaacuagcagugacuaucauggccaucuugugcgucccaaaugcagugauauuacaaaaugcauggaaagugagcugcacgacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuggugauaucaggacuuuuucccgugucaauaccaaucacggcagcugcaugguaccugugggaagugaaaaaacaacgagcaggaguauugugggaugucccuucacccccaccugugggaaaggccgaacuggaagauggagccuacagaaucaagcagaaagggauucuaggauacucgcagaucggagcuggaguuuacaaagaaggaacuuuucacacaauguggcaugucacacguggugcuguccuaaugcauaaagggaagagaauugaaccaucaugggcggacgucaagaaagaucuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggugccgugucucuggacuuuucuccuggaacgucaggaucuccaaucgucgacaaaaaaggaaaaguugugggccuuuauggcaacggugucguuacaaggaguggaacauaugugagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagagugguggcggcugaaauggaagaagcucucagaggacuuccaauaagauaccaaaccccagcuauuagagcugagcacacugggcgggagauuguggaucuaaugugucacgccacauuuaccaugaggcugcuaucaccaauuagagugccaaauuauaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaaugcaccaaucauggaugaagaaagggaaaucccugagcguucguggaacucuggacaugaguggguuacggauuucaaagggaagacuguuugguuuguuccaagcauaaaagcagggaaugacauagcagcuugccugagaaagaauggaaagaaagugauacaacucagcaggaagacuuuugacuuugaauauauaaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaaaaugcuucuagacaacaucaacacgccugaaggaaucauucccagcauguucgaaccagagcgugaaaagguggaugccauugauggugaauaccgcuugagaggagaagcgaggaaaacuuucguggaccuaaugagaagaggagaccuaccagucugguuagccuacagaguggcagcugaagguaucaauuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaguucgcagcuggaagaaagucccugacacugaaucuaaucacagagauggguaggcucccaaccuucaugacccagaaagcaaggaaugcacuggauaacuuagcagucuugcauacagccgaagcaggcggaagggcguacaaucaugcucuuagugaacugccggagacucuggagacauugcuuuuacugacacucuuggccacagucacgggcggaaucuuccuguucuugaugagcggaaaagguauagggaagaugaccuugggaaugugcugcauaaucacggccagcauucuccuaugguaugcacaaauacagccacacuggauagcagcuucaauaauauuggaguuuuuucucauagucuugcucauuccagaaccagaaaagcagagaacgccccaagauaaccaauuaacuuauguugucauagccauccuuacagugguggccgcaaccauggcaaacgagauggguuuucuggaaaaaacaaagaaagauuucggacugggaagcauuacaacccagcaaccugagagcaacauccuggacauagaucuacguccugcaucagcuuggacucuauaugccguggcaacaaccuucaucacaccaauguugagacauagcauugaaaauuccucagugaaugugucucuaacagccauugccaaccaagccacaguguuaaugggucuugggaaaggauggccauugucaaagauggacaucggaguuccccuucucgcuaucgggugcuauucacaagucaaccccauaacucucacagcagcccuucuccuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccaggaagauucuggaauacaacuauugcagugucaauggcuaacauuuuuagagggaguuaccuggccggagccggacuucucuuuucuaucaugaagaacacggccaacacaagaaggggaacuggcaacacgggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacggaccaucaugcugugucgcgaggcucggcgaaacugagaugguucgucgagagaaaccugguuacaccagaagggaaaguaguggaccuugguuguggcaggggaggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuuuacuccgccagaaaagugugacacauugcugugugacauaggggagucgucaccaaaccccacuguugaagcaggacgaacacucagaguucuaaaccuaguggaaaauuggcugaacaauaacacccaauuuugcauaaagguucucaauccauauaugcccucagucauagaaaaaauggaagcgcuacaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacguuaucccuauggugacacagauggcaaugacagacacgacuccauuuggacaacagcgcguuuucaaagagaaaguggacacgagaacccaagaaccgaaagaaggcacgaaaaaacuaaugaagaucacggcagaauggcucuggaaagaacuaggaaagaaaaagacaccuaggaugugcaccagagaagaauucgcaagaaaggugagaaguaaugcagccuuaggcgccauauucacugaugagaauaaguggaagucggcacgugaggcuguugaagacagcggauuuugggaacugguugacaaggaaaggaaucuccaucuugaaggaaagugugagacaugcguauauaacaugaugggaaagagagagaagaaacuaggggaguucggcaaagcgaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaugaaagaaggaggagcaauguacgccgaugacaccgcaggaugggacacaagaaucacacuagaggacuuaaaaaaugaagaaauggugacaaaccacauggaaggagaacacaagaaacuugcugaagccaucuucaaacuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaacugacagucacagaagaaauugcagugaaaaacuggcuaguaagaguggggcgugagagguuaucaagaauggccauuaguggagaugauuguguugugaaacccuuagaugacagguuugcaagcgcucuaacagcucuaaaugacaugggaaagguuaggaaagacauacaacaaugggaaccuucaagaggauggaacgacuggacacaagugccuuuuuguucacaccauuuccaugaguuaaucaugaaggacggucguguacucguaguuccaugcagaaaucaagaugaacugauugguagggcccgaauaucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcuaacaguuuggaacaggguguggauucaagaaaacccauggauggaagacaaaacuccaguggaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagguuuagaagagaagaggaagaggcaggagucuugugguag

SEQ ID NO: 7049 - RNA, 9876 nt, Artificial Sequence
  derived and/or modified CDS sequence (wt) from DENV-2__KC762664__SS-prME
acugcagguauaauuaucaugaugaucccaacagugauggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacuccacgucuacauggguaacuuaugggacaugcaccgccacaggagaacacagaagggaaaaaagaucaguggcacucguuccacaugugggaaugggacuggagacacgaacggaaacauggaugucaucagaaggggccuggaaacaugcccagagaauugaaacuugggucuugagacauccaggcuucaccauaauggcagcaauccuggcauauaccauaggaacaacauauuuccaaagaguccugauuuucauuuuacugacagcugucacucccucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacauccugccacucuaaggaaguauuguauagaggcaaagcugaccaacacaacaacagcaucucgcugcccaacacaaggagaaccuagccuaaacgaagaacaggacaaaagguucgucugcaaacacuccaugguagacagaggauggggaaauggaugcggauuauuuggaaagggaggcaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagagcuaacaggcuauggcacugucacgauggaaugcucuccgagaacgggccucgacuucaaugagaugguguugcugcaaauggaaaauaaggcuuggcuggugcacaggcaaugguucuuagaccugccguuaccauggcugcccggagcagacacacaaggaucaaauuggauacagaaggagacacuggucacuuucaaaaacccccaugcaaagaaacaggauguuguuguuuuaggaucccaagaaggggcuaugcauacagcacucacaggggccacggaaauccagaugucaucaggaaauuuacuguucacaggacaucuuaagugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaacggacuuggaaaaaagacaugguuuaggucgcuugauuacagucaacccaauugucacagaaaaagauagcccagucaacauagaagcagaaccuccauucggagacagcuacauuauuauaggaguagaaccgggacaacugaagcucagcugguuuaagaaaggaaguucuauuggccaaauguuugagacaacaaugagaggagcgaaaagaauggccauuuuaggugacacagcuugggauuuuggaucccugggaggaguguucacaucuauaggaaaggcccuccaccaagucuucggagcuaucuauggggcugccuucagugggguuucauggacuaugaaaauccucauaggagucgucaucacauggauaggaaugaauucacgcagcaccucacugucugugucacuaguauuagugggggucgugacauuguauuugggagucauggugcaggccgauagugguugcguugugaguuggaaaaacaaagaacugaaaugcggcagugggauuuuuaucacagacaacgugcacacauggacagaacaauacaaauuccaaccagaauccccuucaaagcuggcuucagccauccagaaggcucaugaagaaggcauuuguggaauccgcucaguaacaagacuggagaaucugauguggaaacaaauaacaccagaauugaaucacauucuaucagaaaaugagguaaaguugacuaucaugacaggagacauuaaaggaaucaugcaggcaggaaaacgaucccugcggccucaacccacugagcugaaguacucguggaaaacauggggcaaagcgaaaaugcuuuccacagagcuucauaaccacaccuuucucauugauggccccgaaacagcagaaugucccaacgcaaacagagcuuggaauucacuagaaguugaagacuauggcuuuggaguguucaccacuaacauauggcugaaauugaaagaaaggcaggaugcauuuugugacucaaaacucaugucagcagccauaaaagacaacagagccguucacgccgauauggguuauuggauagaaagcgcacucaacgacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccauacacaaacggcaggacccuggcaucuagguaggcuugagauggacuuugauuucugcgaaggaaccacagugguagugacugaggauuguggaaauagaggacccuccuuaagaacaacuacugcuucuggaaaacucauaacagaguggugcugccgaucuugcacauuaccaccacuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugauauaggcaugggcgugacuuaucuugcccuguuagcagccuucaaagucagaccaacuuuugcggcuggacuacucuuaagaaagcugaccuccaaggaauugaugaugaccaccauaggaaucacacuccucucucagaguaccauaccagagacuauacuugaacugacugacgcguuggcuuuggggaugaugguucucaaaauagugagaaacauggaaaaguaccaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacucgcguugacgaucaaaggccucaauccaacagccauuuucuuaacaacccucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaaaaaugaagaagaagaacaaacacugaccauacucauuagaacaggacugcuggugauaucaggacuuuuuccuguaucaauaccaaucacagcagcugcaugguaccugugggaagugaaaaaacaacgggcaggaguauugugggaugucccuucacccccaccuguggaaaaggccgaacuggaagauggagccuauagaaucaagcagaaagggauccuaggauacucgcagauuggagccggaguuuacaaagaaggaacauuccacacaauguggcaugucacacguggugcuguccuaaugcacaaagggaaaagaauugaaccaucaugggcggacgucaagaaagaccuaauaucguauggaggaggcuggaagcuagaaggagaauggaaggaaggagaagagguccagguccuggcauuagagccuggaaagaauccaagagccguccaaacaaaacccggucuuuuuaaaaccagcacuggaaccauaggcgccgugucucuggacuuuucuccuggaacgucaggaucuccaaucgucgacaaaaaaggaaaaguugugggccuuuauggcaacggugucgucacaaggaguggaacauaugugagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacgcuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagauggguaaagcagcugguauuuucaugacagccaccccuccuggaagcagagacccauuuccucagagcaaugcaccaaucauggaugaagaaagagaaaucccugagcguucguggaacucuggacaugaguggguuacggacuuuaaagggaagacuguuugguuuguuccaaguauaaaagcagggaaugauauagcagcuugccugagaaagaauggaaagaaggugauacaacucagcaggaagacuuuugauuuugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuuuuggauaacaucaacacgccugaaggaaucauucccagcauguucgaaccagaacgugaaaagguggaugccauugauggugaauaccgcuugagaggagaagcgaggaaaacuuuuguggaccuaaugagaagaggagaucuaccagucuggcuagccuacagaguggcagcugaagguaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagaugggcagacucccaaccuucaugacccagaaagcaagaaaugcacuggacaacuuagcaguccugcauacggcugaagcaggcggaagggcguacaaucaugcucuuagugaacugccggagacucuggaaacauugcuuuuacugacacuuuuggccacagucacgggcggaaucuuccuguucuugaugagcggaaaagguauagggaagaugacccugggaaugugcugcauaaucacggcuaguauucuccuaugguaugcacaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaacuauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauaguauugaaaauuccucagugaaugugucucuaacagccauugccaaccaagccacaguguuaaugggucuugggaaaggauggccauuaucaaaaauggacaucggaguuccccuucucgcuaucgggugcuauucacaagucaaccccauaacucucacagcagcccuucuccuauugguagcacauuaugcuaucauagggccaggacuccaagcgaaagcaaccagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaucgguugaaugcauugggaaagagugaauuccagaucuauaagaaaaguggaauccaggaaguagauagaaccuuagcaaaagaaggcaucaaaagaggagaaacagaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacuuugcugugugacauaggggagucgucaccaaacccuacgguugaggcaggacgaacacucagaguucuaaacuuaguggaaaauuggcugaauaacaacacccaauuuugcauaaagguucucaacccauacaugcccucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccgaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacaaauggcaaugacagacacgacuccauuuggacaacagcgugucuucaaagagaaaguggacacaagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaccuccaucuugaaggaaagugugagacauguguguauaacaugaugggaaagagagagaaaaaacuaggggaguucggcaaagcaaaaggcagcagagccauaugguacauguggcuuggagcacgcuucuuagaguucgaagcucuaggauuccugaaugaagaucacugguuuuccagagagaacucccugaguggaguggaaggagaaggacugcacaaacuagguuacauuuuaagagacgugagcaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucacuaacauggaagcccaacugaucagacagauggaaggagaaggagucuucaaaagcauccagcaacugacagucacagaagaaauugcagugaaaaacugguuagugacaguggggcgugagagguuaucaagaauggcuaucaguggagaugauuguguugugaaacccuuggaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccgggugguccuugcgagaaacagccuguuuggggaaguccuacgcccaaauguggagccugauguacuuccacagacgugaccuuagacuggcggcaaaugccauuugcucggcaguuccaucacauuggguuccaacaagucgaacaaccugguccauacacgccacacaugaguggaugacaacagaagacaugcugacagucuggaacaggguguggauucaagaaaacccauggauggaagacaaaacuccaguaggaucaugggaggaaaucccguauuuggggaaaagagaagaccaauggugcggcucacugauugggcuaacaagcagggcuaccugggcaaagaacauccaaacagcaauaaaucaagucagaucccuaauaggcaaugaggaauacacagacuacaugccauccaugaaaagauucagaagagaagaggaagaggcaggagucuugugguag

SEQ ID NO: 7050 - RNA, 9876 nt, Artificial Sequence
  derived and/or modified CDS sequence (wt) from DENV-2__KC762674__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacucucauggccauggaccuuggugaacugugugaagacacaaucacuuauaauuguccucuccucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcuuacacuauaggaacgacacauuuccaaagaguccugaucuucaucuuacugacagcugucgcuccuucaaugacaaugcguugcauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaagggaaaauugugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuaugguacuguuacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggcuaugcauacagcacucacaggggccacggaaauccagaugucaucaggaaacuuacuguucacuggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccauguaagaucccuuuugaaauaauggauuuggaaaaaagacauguccuaggucgcuugauuacagucaacccaauugucacagaaaaagacagcccagucaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuugggagggguguucacauccauaggaaaggcccuccaccaagucuuuggagcaaucuauggggcugccuucagugggguuucauggacuaugaaaauccucauaggagucgucaucacauggauaggaaugaauucacgcagcacuucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggccucagcuauccagaaggcucacgaagaaggcauuuguggaauccgcucaguaacaagacuggagaaucugauguggaaacaaauaacaccagaacugaaucacauucuaucagaaaaugaggugaaguugacuaucaugacaggagacauuaaaggaaucaugcaggcaggaaaacgaucccugcggccucaacccacugagcugaaguacucuuggaaaacauggggcaaagcgaaaaugcucuccacagagcuucacaaccacaccuuucucauugauggccccgaaacagcagaaugucccaacacaaacagagcuuggaacucacuagaagucgaagacuauggcuuuggaguauucaccaccaacauauggcugaaauugaaagaaaggcaggacguauauugugacucaaaacucaugucagcagccauaaaagauaacagagccguccacgcugauauggguuauuggauagaaagugcacucaaugacacauggaagauugagaaagccucuuuuauugaaguuaaaagcugcuacuggccaaagucacacacccucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaaccacagugguggugacugaggacuguggaaauagaggacccucuuuaagaacaacuacugcuucuggaaaacucauaacagaguggugcugccgaucuugcacauuaccaccacuaagguacagaggugaggauggaugcugguauggaauggaaauuagaccacugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggauuacucuuaagaaagcugaccuccaaggaauugaugaugaccaccauaggaaucgugcuccucucccagagcaccauaccagagacuauacuugaacugacugacgcauuggcuuuggggaugauggcucucaaaauagugagaaacauggaaaaguaucaacuagcagugacuaucauggccaucuugugcguuccaaaugcagugauauuacaaaacgcauggaaagugagcugcacaacacuggcagugguguccguuuccccacugcuuuuaacauccucacagcagaaagcggauuggauaccacuggcguugacgaucaaaggccuuaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacguacucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuagugauaucaggacuuuuucccguaucaauaccaaucacggcagcugcaugguaccugugggaagugaaaaaacaacgagcaggaguauugugggauguccccucacccccaccugugggaaaagccgaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaaguuagaaggagaauggaaagaaggagaagaaguccagguccuggcauuagagccuggaaagaauccaagagcuguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaacggugucguuacaaggaguggaacauaugugagugcuauagcccagacugaaaaaaguaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacgcuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaacuugauuaucauggaugaagcccauuucacagacccagcaagcauagcagcuagaggauacauuucaacucgaguagagaugggugaagcagcugggauuuucaugacagcuaccccuccuggaaguagagacccauuuccucagagcaaugcaccaaucauggaugaagaaagggaaaucccugagcguucguggaacucuggacaugaauggguuacggauuuuaaagggaagacuguuugguuuguuccaagcauaaaagcagggaaugauauagcagcuugccugagaaagaauggaaagaaagugauacaacucagcaggaagacuuuugauuuugaauauauuaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagccaaaaugcuucuagacaacaucaacacgccugaaggaaucauucccagcauguucgaaccagagcgugaaaagguggaugccauugauggugaauaccgcuugagaggagaagcaagaaaaacuuuuguggaccuaaugagaagaggagaccuaccagucugguuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauugaaacccagaugguuggaugcuaggaucuauucugacccacuggcgcucaaagaauucaaggaauucgcagcuggaagaaagucccugacccugaaucuaaucacagagauggguaggcucccaaccuucaugacccagaaagcaaggaaugcacuggacaacuuagcagucuugcauacagcugaagcaggcggaagggcguacaaucaugcucuuagugaacugccggagacucuggagacauugcuuuuacugacacucuuggccacagucacgggcggaaucuuccuguucuugaugaguggaaaggguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaaugagauggguuuccuggaaaaaacaaagaaagauuucggauugggaagcauuacaacccagcaaccugagagcaauauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacagcagcccuucucuuauugguagcacauuaugcuaucauagggccaggacuccaagcgaaagcaacuagagaggcucaaaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccaggaagauucuggaauacaacuauugcagugucaauggcuaacauuuuuagagggaguuacuuggccggagccggacuucucuuuucuaucaugaagaacacggcuaacacaagaaggggaacuggcaacacaggagagacgcuuggagagaaauggaaaaaccgguugaaugcauuggggaagagugaauuccagaucuauaagaaaaguggaauccaggaaguggauagaaccuuggcaaaagaaggcaucaaaagaggagaaacagaccaucacgcugugucgcgaggcucggcgaaacugagaugguucgucgagagaaaccuggucacaccagaagggaaaguaguggaccuugguugcggcagggggggcuggucauacuauugugggggacuaaagaauguaaaagaagucaaaggccuaacaaaaggaggaccaggacacgaagaacccauucccaugucaacauauggcuggaaucuggugcgucuucaaaguggaguugauguuuuuuucacuccgccagaaaagugugauacauugcugugugacauaggggagucgucaccaaaccccacgguugaagcaggacgaacucucagaguucuaaacuuaguggaaaauuggcugaacaacaacacccaauuuugcauaaagguucuuaacccauauaugcccucaguuauagaaaaaauggaagcacuacaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagauguugaccucggaaguggaacccgcaacaucggaauugaaagugagauaccaaauuuagacauaauugggaaaagaauagaaaaaauaaaacaagagcaugaaacaucauggcauuaugaccaagaucacccauacaaaacgugggccuaucauggcagcuacgaaacaaaacagacuggaucagcaucauccauggugaacggagugguuagguugcuaacaaaaccuugggacguuaucccuauggugacacagauggcaaugacagauacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaaguaaugcagccuuaggcgccauauucacugaugagaacaaguggaagucggcacgugaggcuguugaagacaguggauuuugggaauugguugacaaggaaaggaaucuccaucuugaaggaaagugugagacauguguauauaacaugaugggaaagagagagaagaagcuaggggaguuuggcaaagcgaaaggcagcagagccauaugguacauguggcuuggagcacgcuucuuagaguuugaagcccuaggauucuugaacgaagaucacugguuuuccagagagaacucccugaguggaguggaaggagaagggcugcacaaacuaggcuacauuuuaagagacgugaguaagaaagaaggaggagcaauguacgcugaugacaccgcaggaugggacacaagaaucacauuagaggacuuaaaaaacgaagaaauggugacaaaccacauggaaggagaacacaagaaacuugcugaagccaucuucaaauuaacguaccaaaacaagguggugcgugugcaaagaccaacgccaagaggcacagugauggacauuauaucgagaagagaccaaagagguagcggacaaguugucaccuacggccucaauacuuucaccaacauggaagcccaacugaucagacagauggagggagaaggagucuucaaaagcauccagcaauugacagucacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugccuuuuuguucacaccauuuccaugaguuaaucaugaaggacggucguguacucguaguuccaugcagaaaucaagaugaacugauugguagggcccgaauuucccagggagccgggugguccuugcgggaaacagccuguuuggggaagucuuacgcccaaauguggagccugauguacuuccacagacgugaccuuaggcuggcagcaaaugccauuugcucggcagucccaucacacuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaauuccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaagaggaagaggcaggagucuugugguag

SEQ ID NO: 7051 - RNA, 9876 nt, Artificial Sequence
  derived and/or modified CDS sequence (wt) from DENV-2__KC762672__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacugcuggugcaacucuacgucuacauggguaacuuacgggacaugcaccgccacaggagaacacagaagggaaaaaagaucaguggcacucguuccacaugugggaaugggacuggagacacgaacugaaacauggaugucaucagaaggggccuggaaacaugcccagagaauugaaacgugggucuugagacauccaggcuucaccauaauggcagcaauccuggcuuacaccauaggaacgacauauuuccaaagaguccugaucuucaucuuacugacagcugucgcuccuucaaugacaaugcguuguauaggaauaucaaauagagacuuuguggaagggguaucaggaggaagcuggguugacauagucuuggaacauggaagcugugugacgacgauggcaaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggagguaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacgguaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggccaugcacacagcacucacaggggccacggaaauccagaugucaucaggaaacuugcuguucacaggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugauuacagucaacccaauugucacagaaaaagacagcccagucaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuugggagggguguucacauccauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguugggaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuagagaaucugauguggaaacaaauaacaccagaacugaaucacauucuaucagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuccucauugauggccccgaaacagcagaaugucccaacacaaacagagcuuggaacucacuagaaguugaagacuauggcuuuggaguauuuaccaccaacauauggcugaaauugaaagaaaggcaggauguauuuugugacucaaaacucaugucagcagccauaaaagacagcagagccguccacgccgauauggguuauuggauagaaagcgcacucaacgacacauggaagauugagaaagccucuuuuauugaaguuaaaagcugccacuggccaaagucacacacucucuggaguaauggagugcuagaaagugagaugauaauuccaaagaacuuugcaggaccagugucacaacacaauuacagaccaggcuaucauacacaaacggcaggacccuggcaucuaggcaggcuugagauggacuucgauuucugcgaaggaaccacagugguggugacugaggacuguggaaauagaggaccuucuuuaagaacaacuacugcuucuggaaaacucauaacagagugguguugccgaucuugcacauuaccaccgcuaagguacagaggugaggauggaugcugguauggaauggaaauuagaccauugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaaucgugcuccucucccaggccaccauaccagagacuauacuugaacugacugacgcguuggcuuuggggaugaugguucucaaaauagugagaaacauggaaaaguaucaacuagcagugacuaucauggccaucuugugcgucccaaaugcagugauauuacaaaaugcauggaaagugagcugcacgacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuggugauaucaggacuuuuucccgugucaauaccaaucacggcagcugcaugguaccugugggaagugaaaaaacaacgagcaggaguauugugggaugucccuucacccccaccugugggaaaggccgaacuggaagauggagccuacagaaucaagcagaaagggauucuaggauacucgcagaucggagcuggaguuuacaaagaaggaacuuuucacacaauguggcaugucacacguggugcuguccuaaugcauaaagggaagagaauugaaccaucaugggcggacgucaagaaagaucuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggugccgugucucuggacuuuucuccuggaacgucaggaucuccaaucgucgacaaaaaaggaaaaguugugggccuuuauggcaacggugucguuacaaggaguggaacauaugugagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagagugguggcggcugaaauggaagaagcucucagaggacuuccaauaagauaccaaaccccagcuauuagagcugagcacacugggcgggagauuguggaucuaaugugucacgccacauuuaccaugaggcugcuaucaccaauuagagugccaaauuauaaccugauuaucauggaugaagcccauuuuacagacccagcaagcauagcagcuagaggauacauuucaacucgaguagagaugggugaagcagcugggauuuucaugacagccaccccucccggaagcagagacccauuuccucagagcaaugcaccaaucauggaugaagaaagggaaaucccugagcguucguggaacucuggacaugaguggguuacggauuucaaagggaagacuguuugguuuguuccaagcauaaaagcagggaaugacauagcagcuugccugagaaagaauggaaagaaagugauacaacucagcaggaagacuuuugacuuugaauauauaaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaaaaugcuucuagacaacaucaacacgccugaaggaaucauucccagcauguucgaaccagagcgugaaaagguggaugccauugauggugaauaccgcuugagaggagaagcgaggaaaacuuucguggaccuaaugagaagaggagaccuaccagucugguuagccuacagaguggcagcugaagguaucaauuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaguucgcagcuggaagaaagucccugacacugaaucuaaucacagagauggguaggcucccaaccuucaugacccagaaagcaaggaaugcacuggauaacuuagcagucuugcauacagccgaagcaggcggaagggcguacaaucaugcucuuagugaacugccggagacucuggagacauugcuuuuacugacacucuuggccacagucacgggcggaaucuuccuguucuugaugagcggaaaagguauagggaagaugaccuugggaaugugcugcauaaucacggccagcauucuccuaugguaugcacaaauacagccacacuggauagcagcuucaauaauauuggaguuuuuucucauagucuugcucauuccagaaccagaaaagcagagaacgccccaagauaaccaauuaacuuauguugucauagccauccuuacagugguggccgcaaccauggcaaacgagauggguuuucuggaaaaaacaaagaaagauuucggacugggaagcauuacaacccagcaaccugagagcaacauccuggacauagaucuacguccugcaucagcuuggacucuauaugccguggcaacaaccuucaucacaccaauguugagacauagcauugaaaauuccucagugaaugugucucuaacagccauugccaaccaagccacaguguuaaugggucuugggaaaggauggccauugucaaagauggacaucggaguuccccuucucgcuaucgggugcuauucacaagucaaccccauaacucucacagcagcccuucuccuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccaggaagauucuggaauacaacuauugcagugucaauggcuaacauuuuuagagggaguuaccuggccggggccggacuucucuuuucuaucaugaagaacacggccaacacaagaaggggaacuggcaacgcgggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacggaccaucaugcugugucgcgaggcucggcgaaacugagaugguucgucgagagaaaccugguuacaccagaagggaaaguaguggaccuugguuguggcaggggaggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuuuacuccgccagaaaagugugacacauugcugugugacauaggggagucgucaccaaaccccacuguugaagcaggacgaacacucagaguucuaaaccuaguggaaaauuggcugaacaauaacacccaauuuugcauaaagguucucaauccauauaugcccucagucauagaaaaaauggaagcgcuacaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacguuaucccuauggugacacagauggcaaugacagacacgacuccauuuggacaacagcgcguuuucaaagagaaaguggacacgagaacccaagaaccgaaagaaggcacgaaaaaacuaaugaagaucacggcagaauggcucuggaaagaacuaggaaagaaaaagacaccuaggaugugcaccagagaagaauucgcaagaaaggugagaaguaaugcagccuuaggcgccauauucacugaugagaauaaguggaagucggcacgugaggcuguugaagacagcggauuuugggaacugguugacaaggaaaggaaucuccaucuugaaggaaagugugagacaugcguauauaacaugaugggaaagagagagaagaaacuaggggaguucggcaaagcgaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaugaaagaaggaggagcaauguacgccgaugacaccgcaggaugggacacaagaaucacacuagaggacuuaaaaaaugaagaaauggugacaaaccacauggaaggagaacacaagaaacuugcugaagccaucuucaaacuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaacugacagucacagaagaaauugcagugaaaaacuggcuaguaagaguggggcgugagagguuaucaagaauggccauuaguggagaugauuguguugugaaacccuuagaugacagguuugcaagcgcucuaacagcucuaaaugacaugggaaagguuaggaaagacauacaacaaugggaaccuucaagaggauggaacgacuggacacaagugccuuuuuguucacaccauuuccaugaguuaaucaugaaggacggucguguacucguaguuccaugcagaaaucaagaugaacugauugguagggcccgaauaucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcuaacaguuuggaacaggguguggauucaagaaaacccauggauggaagacaaaacuccaguggaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagguuuagaagagaagaggaagaggcaggagucuugugguag

SEQ ID NO: 7052 - RNA, 9876 nt, Artificial Sequence
  derived and/or modified CDS sequence (wt) from DENV-2__KC762667__SS-prME
acugcagguauaauuaucaugaugaucccaacagugauggcguuccauuuaaccacacgcaacggagaaccacacaugaucgucaguagacaagagaaagggaaaagucuucuguuuaaaacagagaacggugugaacauguguacccucauggccauggaucuuggugaacugugugaagacacaaucacuuacaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacggaaacauggaugucaucagaaggggccuggaaacaugcccagagaauugaaacuugggucuugagacauccaggcuucaccauaauggcagcaauccuggcauauaccauaggaacaacauauuuccaaagaguccugauuuucauuuuacugacagccgucacucccucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaacgaagaacaggacaaaagguucgucugcaaacacuccaugguagacagaggauggggaaauggaugcggauuauuuggaaagggaggcaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguuguuguuuuaggaucccaagaaggggcuaugcauacagcacucacaggggccacggaaauucagaugucaucaggaaacuuacuguuuacaggacaucuuaagugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggacuuggaaaaaagacauguuuuaggucgcuugauuacagucaacccaauugucacagaaaaagauagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuucggagcuaucuauggggcugccuucagugggguuucauggacuaugaaaauccucauaggagucgucaucacauggauaggaaugaauucacgcagcaccucacugucugugucacuaguauuagugggggucgugacauuguaucugggagucauggugcaggccgauagugguugcguugugaguuggaaaaacaaagaacugaaaugcggcagugggauuuuuaucacagacaacgugcacacauggacagaacaauacaaauuccaaccagaauccccuucaaagcuggcuucagccauccagaaggcucaugaagaaggcauuuguggaauccgcucaguaacaagacuggagaaucugauguggaaacaaauaacaccagaauugaaucacauucuaucagaaaaugagguaaaguugacuaucaugacaggagacauuaaaggaaucaugcaggcaggaaaacgaucccugcggccucaacccacugagcugaaguacucguggaaaacauggggcaaagcgaaaaugcuuuccacagagcuucauaaccacaccuuucucauugauggccccgaaacagcagaaugucccaacgcaaacagagcuuggaauucacuagaaguugaagacuauggcuuuggaguauucaccacuaacauauggcugaaauugaaagaaaggcaggaugcauuuugugacucaaaacucaugucagcagccauaaaagacaacagagccguccacgccgauauggguuauuggauagaaagugcacucaacgacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaucauacacaaacggcaggacccuggcaucuagguaggcuugagauggacuuugauuucugcgaaggaaccacagugguggugacugaggauuguggaaauagaggacccuccuuaagaacaacuacugcuucuggaaaacucauaacagaguggugcugccgaucuugcacauuaccaccacuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucucgcccuauuagcagccuucaaagucagaccaacuuuugcggcuggacuacucuuaagaaagcugaccuccaaggaauugaugaugaccaccauaggagucacacuccucucucagaguaccauaccagagacuauacuugaacugacugacgcguuggcuuuggggaugaugguucucaaaauagugagaaacauggaaaaguaccaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuugcguugacgaucaaaggccucaauccaacagccauuuucuuaacaacccucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaaaaaugaagaagaagaacaaacacugaccauacucauuagaacaggacugcuggugauaucaggacuuuuuccuguaucaauaccaaucacagcagcugcaugguaccugugggaagugaaaaaacaacgggcaggaguauugugggaugucccuucacccccaccugugggaaaggccgaacuggaagauggagccuauagaaucaagcagaaagggauccuaggauacucgcagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaaccagcacuggaaccauaggcgccgugucucuggacuuuucuccuggaacgucaggaucuccaaucgucgacaaaaaaggaaaaguugugggccuuuauggcaacggugucgucacaaggaguggaacauaugugagugccauagcccagacugaaaagagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagccaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugguauuuucaugacagcuaccccuccuggaagcagagacccauuuccucagagcaaugcaccaaucauggaugaagaaagagaaaucccugagcguucguggaacucuggacaugaguggguuacggacuuuaaagggaagacuguuugguuuguuccaaguauaaaagcagggaaugauauagcagcuugccugagaaagaauggaaagaaggugauacaacucagcaggaagacuuuugauuuugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuuuuggauaacaucaacacgccugaaggaaucauucccagcauguucgaaccagaacgugaaaagguggaugccauugauggugaauaccgcuugagaggagaagcgaggaaaacuuuuguggaccuaaugagaagaggagaucuaccagucuggcuagccuacagaguggcagcugaagguaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguagacucccaaccuucaugacccagaaagcaaggaaugcacuggacaacuuagcaguccugcauacggcugaagcaggcggaagggcguacaaucaugcucuuagugaacugccggagacucuggaaacauugcuuuuacugacacuuuuggccacagucacgggcggaaucuuccuguucuugaugagcggaaaagguauagggaagaugacccugggaaugugcugcauaaucacggcuaguauucuccuaugguaugcacaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaaccauggcaaacgagauggguuuccuggaaaaaacaaagaaagauuucggauugggaagcauaacaacccagcaaccugagaguaacauccuggacauagaucuacguccugcaucagcuuggacucuauaugccguggcaacaacuuucaucacaccaauguugaggcauaguauugaaaauuccucagugaaugugucucuaacagccauugccaaccaagccacaguguuaaugggucuugggaaaggauggccauuaucaaaaauggacaucggaguuccccuucucgcuaucgggugcuauucacaagucaaccccauaacucucacagcagcccuucucuuauugguagcacauuaugcuaucauagggccaggacuccaagcgaaagcaaccagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuccucuuuucuaucaugaaaaacacggccaacacaagaaggggaacuggcaacacaggagagacgcuuggagagaaauggaaaaaucgguugaaugcauugggaaagagugaauuccagaucuauaagaaaaguggaauccaggaaguagauagaaccuuagcaaaagaaggcaucaaaagaggagaaacagaccaucacgcugugucgcgaggcucagcgaaacugagaugguucgucgagagaaaccugguuacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacuuugcugugugacauaggggagucgucaccaaacccuacgguugaggcaggacgaacacucagaguucuaaacuuaguggaaaauuggcugaauaacaacacccaauuuugcauaaagguucucaacccauacaugcccucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagcuacauacgagccagauguugaccucggaaguggaacccgcaacaucggaauugaaagugagacaccaaauuuagacauaauugggaaaagaauagaaaaaauaaaacgagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacaaauggcaaugacagacacgacuccauuuggacaacagcgcgucuucaaagagaaaguggacacaagaacccaagaaccgaaagaaggcacaaaaaaacuaaugaaaaucacggcagaauggcucuggaaagaacuaggaaagaaaaagacaccuaggaugugcacuagagaagaauucacaagaaaggugagaagcaaugcagccuuaggugccauauucacugaugagaacaaguggaagucagcacgugaggcuguugaagacaguggauuuugggaauugguugacaaggaaaggaaccuccaucuugaaggaaagugugagacauguguguauaacaugaugggaaagagagagaaaaaacuaggggaguucggcaaagcaaaaggcagcagagccauaugguacauguggcuuggagcacgcuucuuagaguucgaagcucuaggauuccugaaugaagaucacugguuuuccagagagaacucccugaguggaguggaaggagaaggacugcacaaacuaggcuacauuuuaagagacgugaguaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucacuaacauggaagcccaacugaucagacagauggaaggagaaggagucuucaaaagcauccagcaccugacagucacagaagaaauugcagugaaaaacugguuagugagaguggggcgugagagguuaucaagaauggcuaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccgggugguccuugcgggaaacagccuguuugggaaaguccuacgcccaaauguggagccugauguacuuccacagacgugaccuuagacuggcggcaaaugccauuugcucggcaguuccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggcuaccugggcaaagaacauccaaacagcaauaaaucaagucagaucccuaauaggcaaugaggaauacacagacuacaugccauccaugaaaagauucagaagagaagaggaagaggcaggagucuugugguag

SEQ ID NO: 7053 - RNA, 9876 nt, Artificial Sequence
  derived and/or modified CDS sequence (wt) from DENV-2__KC762659__SS-prME
acugcagguauaauuauuaugaugaucccaacagugauggcguuccauuuaaccacacgcaacggagaaccacacaugaucgucaguagacaagagaaggggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcauacaccauaggaacaacauauuuccaaagaguccugauuuucauuuuacucacagcugucacuccuucaaugacaaugcguuguauaggaauaucaaauagagacuuuguggaagggguuucaggaggaagcuggguugacauagucuuggaacauggaagcugugugacgacgauggcgaaaaauaaaccaacacuggauuucgaauugauaaaaacagaagccaaacaucccgcuacucuaaggaaguauuguauagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaauaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguuguuguuuuaggaucccaagaaggggcuaugcauacagcacucacaggggccacggaaauccagaugucaucaggaaacuugcuguucacaggacaucuuaagugcaggcugagaauggacaaacuacagcuuaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggacuuggaaaaaagacaugucuuaggucgcuugauuacaguuaacccaauugucacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauucuaggugacacagcuugggauuuuggaucccuaggaggaguguucacaucuauaggaaaggcccuccaccaagucuuuggagcuaucuauggggcugccuucagugggguuucauggacuaugaaaauccucauaggagucgucaucacguggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauauuuaucacagacaacgugcacacauggacagaacaauacaaauuucaaccagaguccccuucaaagcuggcuucagcuauccagaaggcucaugaggaaggcauuuguggaauccgcucaguaacaagacuggagaaucugauguggaaacaaauaacaccagaauugaaucacauccuaucagaaaaugagguaaaguugacuaucaugacaggagacauuaaaggaaucaugcaggcaggaaaacgaucucugcgaccucaacccacugagcugaaguacucuuggaaaacauggggcaaagcgaaaaugcuuuccacagagcuucauaaccacaccuuucucauugauggccccgaaacagcagaaugucccaacacaaacagagcuuggaauucacuagaaguugaagacuauggcuuuggaguauucaccacuaacauauggcugaaauugaaagaaaggcaggauguauuuugugacucaaaacucaugucagcagccauaaaagacaacagagccguccacgccgauauggguuauuggauggaaagcgcacucaaugacacauggaagauugagaaagccucuuuuauugaaguuaaaagcugccacuggccaaagucacacacucuuuggaguaauggagugcuggaaagugagaugauaauuccaaagaauuuugcaggaccagugucacaacacaauuacagaccaggcuaucauacacaaacggcaggacccuggcaucuaggcaggcuugagauggacuuugauuucugugaaggaaccacagugguggugacugaggacuguggaaauagaggacccuccuuaagaacaacuacugcuucuggaaaacuuauaacagaguggugcugucgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcgauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggauuacucuuaagaaggcugaccuccaaggaauugaugaugaccaccauaggaaucguacuccucucucagaguaccauaccagagacuauacuugaacugacugacgcguuggcuuuggggaugaugguucucaaaauagugagaaaaauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaaaaaugaagaagaagaacaaacacugaccauacucauuagaacaggacugcuggugauaucaggacuuuuuccggugucaauaccaaucacggcagcugcaugguaccugugggaagugaaaaagcaacgagcaggaguauugugggaugucccuucacccccaccugugggaaaggccgaacuggaagauggagccuauagaaucaagcagaaagggauucuaggauacucgcagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaaccaauacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaggaugacaucuuucgaaagaaaagauugaccaucauggaccuccacccaggagcaggaaaaacaaagagauaccuuccagcaauagucagagaagccauaaaacgaggcuugaggacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauuuccucagagcaaugcaccaaucauggaugaagaaagagaaaucccugagcguucguggaacucuggacaugaguggguuacggauuuuaaagggaagacuguuugguucguuccaaguauaaaagcagggaaugacauagcagcuugccugagaaagaauggaaagaaagugauacaacucagcaggaagacuuuugauuuugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccacucuagugcagcacaaagaagagggagagugggaagaaauccaaaaaaugaaaaugaccaguacauauacaugggggaaccucuggaaaaugaugaagacugugcacacuggaaagaagcuaagaugcuuuuggauaacaucaacacgccugaaggaaucauucccagcauguucgaaccagagcgugaaaagguggaugccauugauggugaauaccgccugagaggagaagcgaggaaaacuuuuguggaccuaaugagaagaggagaucuaccagucuggcuagccuacagaguggcagcugaagguaucaacuacgcagacagaagauggugcuuugauggagucaagaacaaccaaaucuuggaagaaaauguggaaguagaaauuuggacaaaagaaggagaaaggaaaaaauuaaaacccagauggcuggaugcuaggaucuacucugacccacuggcgcucaaagaauucaaggaauucgcagcuggaagaaagucccugacccugaaucuaaucacagagauggguagacucccaaccuucaugacccagaaagcaaggaaugcacuggacaacuuagcaguccugcauacggcugaagcaggcggaagggcguacaaucaugcucuuagugaacugccggagacucuggagacauuacuuuuacugacacucuuggccacagucacgggcggaaucuuccuguucuugaugagcggaaaggguauagggaagaugacccugggaaugugcugcauaaucacggcuaguauucuccuaugguaugcacaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaaccauggcaaacgagauggguuuccuggaaaaaacaaagaaagauuucggauugggaagcauuacaacccagcaaucugaaaguaacauccuggacauagaucuacguccugcaucagcuuggacucuauaugccguagcaacaacuuucaucacaccaauguugaggcauagcauugaaaauuccucagugaaugugucucuaacagccauugccaaccaagccacaguguuaaugggucuugggaaaggauggccauuaucaaaaauggacaucggaguuccccuucucgcuaucgggugcuauucacaagucaaccccauaacucucacagcagcccuucucuuauugguagcacauuaugcuaucauagggccaggacuccaagcgaaagcaacuagagaggcucagaaaagagcagcagcgggcaucaugaaaaacccaacuguggauggaauaacagugauugacuuagacccaauacccuaugauccaaaguuugagaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggcaggagccggacuucucuuuuccaucaugaaaaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaagguaucaaaagaggagaaacggaccaucacgcugugucgcgaggcucagcgaagcugagaugguucgucgagagaaaccuggucacaccagaagggaaaguaguggaccuuggcugcgguagggggggcuggucauacuauugugggggacuaaagaauguaaaagaaguuaaaggccuaacaaaaggaggaccaggacacgaagaacccauucccaugucaacauaugguuggaaucugguacgucuucaaaguggaguugauguuuuuuuuacuccaccagaaaagugcgacacauuacugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcgcuacaaaggaaauacggaggagcuuuggugaggaauccacucucacgaaauuccacacacgagauguacuggguaucuaaugcuuccgggaacauagugucaucagugaacaugauuucaagaaugcugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaacccugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcuuuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcucggagcacgcuucuuagaguuugaagcucuaggauuuuugaaugaagaucacugguuuucuagagagaacucccugaguggaguggaaggagaagggcugcacaaacuaggcuacauuuuaagagacgugagcaagaaagaaggaggagcaauguaugccgaugacaccgcaggaugggacacaagaaucacacuagaggaccuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggaaggagaaggagucuucaaaagcauccagcaacugacagccacagaagaaauugcagugaaaaacugguuaguaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccuguuuggggaaguccuacgcccaaauguggagccugauguacuuucacagacgugaccuuaggcuggcggcaaaugccauuugcucagcggucccaucacauuggguuccaacaagucgaacaaccugguccauacacgccacacaugaguggaugacaacagaagacaugcugacagucuggaacaggguguggauucaagaaaacccauggauagaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7054 - RNA, 9876 nt, Artificial Sequence
  derived and/or modified CDS sequence (wt) from DENV-2__KC762657__SS-prME
acugcagguauaauuauuaugaugaucccaacagugaugguguuccauuuaaccacacgcaacggagaaccacacaugaucgucaguagacaagagaaggggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcauacaccauaggaacaacauauuuccaaagaguccugauuuucauuuuacucacagcugucacuccuucaaugacaaugcguuguauaggaauaucaaauagagacuuuguggaagggguuucaggaggaagcuggguugacauagucuuggaacauggaagcugugugacgacgauggcgaaaaauaaaccaacacuggauuucgaauugauaaaaacagaagccaaacaucccgcuacucuaaggaaguauuguauagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaauaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguuguuguuuuaggaucccaagaaggggcuaugcauacagcacucacaggggccacggaaauccagaugucaucaggaaacuugcuguucacaggacaucuuaagugcaggcugagaauggacaaacuacagcuuaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggacuuggaaaaaagacaugucuuaggucgcuugauuacaguuaacccaauugucacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauucuaggugacacagcuugggauuuuggaucccuaggaggaguguucacaucuauaggaaaggcccuccaccaagucuuuggagcuaucuauggggcugccuucagugggguuucauggacuaugaaaauccucauaggagucgucaucacguggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauauuuaucacagacaacgugcacacauggacagaacaauacaaauuucaaccagaguccccuucaaagcuggcuucagcuauccagaaggcucaugaggaaggcauuuguggaauccgcucaguaacaagacuggagaaucugauguggaaacaaauaacaccagaauugaaucacauccuaucagaaaaugagguaaaguugacuaucaugacaggagacauuaaaggaaucaugcaggcaggaaaacgaucucugcgaccucaacccacugagcugaaguacucuuggaaaacauggggcaaagcgaaaaugcuuuccacagagcuucauaaccacaccuuucucauugauggccccgaaacagcagaaugucccaacacaaacagagcuuggaauucacuagaaguugaagacuauggcuuuggaguauucaccacuaacauauggcugaaauugaaagaaaggcaggauguauuuugugacucaaaacucaugucagcagccauaaaagacaacagagccguccacgccgauauggguuauuggauggaaagcgcacucaaugacacauggaagauugagaaagccucuuuuauugaaguuaaaagcugccacuggccaaagucacacacucuuuggaguaauggagugcuggaaagugagaugauaauuccaaagaauuuugcaggaccagugucacaacacaauuacagaccaggcuaucauacacaaacggcaggacccuggcaucuaggcaggcuugagauggacuuugauuucugugaaggaaccacagugguggugacugaggacuguggaaauagaggacccuccuuaagaacaacuacugcuucuggaaaacuuauaacagaguggugcugucgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcgauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggauuacucuuaagaaggcugaccuccaaggaauugaugaugaccaccauaggaaucguacuccucucucagaguaccauaccagagacuauacuugaacugacugacgcguuggcuuuggggaugaugguucucaaaauagugagaaaaauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaaaaaugaagaagaagaacaaacacugaccauacucauuagaacaggacugcuggugauaucaggacuuuuuccggugucaauaccaaucacggcagcugcaugguaccugugggaagugaaaaagcaacgagcaggaguauugugggaugucccuucacccccaccugugggaaaggccgaacuggaagauggagccuauagaaucaagcagaaagggauucuaggauacucgcagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaaccaauacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaggaugacaucuuucgaaagaaaagauugaccaucauggaccuccacccaggagcaggaaaaacaaagagauaccuuccagcaauagucagagaagccauaaaacgaggcuugaggacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauuuccucagagcaaugcaccaaucauggaugaagaaagagaaaucccugagcguucguggaacucuggacaugaguggguuacggauuuuaaagggaagacuguuugguuuguuccaaguauaaaagcagggaaugacauagcagcuugccugagaaagaauggaaagaaagugauacaacucagcaggaagacuuuugauuuugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccacucuagugcagcacaaagaagagggagagugggaagaaauccaaaaaaugaaaaugaccaguacauauacaugggggaaccucuggaaaaugaugaagacugugcacacuggaaagaagcuaagaugcuuuuggauaacaucaacacgccugaaggaaucauucccagcauguucgaaccagagcgugaaaagguggaugccauugauggugaauaccgccugagaggagaagcgaggaaaacuuuuguggaccuaaugagaagaggagaucuaccagucuggcuagccuacagaguggcagcugaagguaucaacuacgcagacagaagauggugcuuugauggagucaagaacaaccaaaucuuggaagaaaauguggaaguagaaauuuggacaaaagaaggagaaaggaaaaaauuaaaacccagauggcuggaugcuaggaucuacucugacccacuggcgcucaaagaauucaaggaauucgcagcuggaagaaagucccugacccugaaucuaaucacagagauggguagacucccaaccuucaugacccagaaagcaaggaaugcacuggacaacuuagcaguccugcauacggcugaagcaggcggaagggcguacaaucaugcucuuagugaacugccggagacucuggagacauuacuuuuacugacacucuuggccacagucacgggcggaaucuuccuguucuugaugagcggaaaggguauagggaagaugacccugggaaugugcugcauaaucacggcuaguauucuccuaugguaugcacaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaaccauggcaaacgagauggguuuccuggaaaaaacaaagaaagauuucggauugggaagcauuacaacccagcaaucugaaaguaacauccuggacauagaucuacguccugcaucagcuuggacucuauaugccguagcaacaacuuucaucacaccaauguugaggcauagcauugaaaauuccucagugaaugugucucuaacagccauugccaaccaagccacaguguuaaugggucuugggaaaggauggccauuaucaaaaauggacaucggaguuccccuucucgcuaucgggugcuauucacaagucaaccccauaacucucacagcagcccuucucuuauugguagcacauuaugcuaucauagggccaggacuccaagcgaaagcaacuagagaggcucagaaaagagcagcagcgggcaucaugaaaaacccaacuguggauggaauaacagugauugacuuagacccaauacccuaugauccaaaguuugagaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggcaggagccggacuucucuuuuccaucaugaaaaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaagguaucaaaagaggagaaacggaccaucacgcugugucgcgaggcucagcgaagcugagaugguucgucgagagaaaccuggucacaccagaagggaaaguaguggaccuuggcugcgguagggggggcuggucauacuauugugggggacuaaagaauguaaaagaaguuaaaggccuaacaaaaggaggaccaggacacgaagaacccauucccaugucaacauaugguuggaaucugguacgucuucaaaguggaguugauguuuuuuuuacuccaccagaaaagugcgacacauuacugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcgcuacaaaggaaauacggaggagcuuuggugaggaauccacucucacgaaauuccacacacgagauguacuggguaucuaaugcuuccgggaacauagugucaucagugaacaugauuucaagaaugcugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaacccugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcuuuggaaagaauuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcucggagcacgcuucuuagaguuugaagcucuaggauuuuugaaugaagaucacugguuuucuagagagaacucccugaguggaguggaaggagaagggcugcacaaacuaggcuacauuuuaagagacgugagcaagaaagaaggaggagcaauguaugccgaugacaccgcaggaugggacacaagaaucacacuagaggaccuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggaaggagaaggagucuucaaaagcauccagcaccugacagccacagaagaaauugcagugaaaaacugguuaguaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccuguuuggggaaguccuacgcccaaauguggagccugauguacuuucacagacgugaccuuaggcuggcggcaaaugccauuugcucagcggucccaucacauuggguuccaacaagucgaacaaccugguccauacacgccacacaugaguggaugacaacagaagacaugcugacagucuggaacaggguguggauucaagaaaacccauggauagaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7055 - RNA, 9876 nt, Artificial Sequence
  derived and/or modified CDS sequence (wt) from DENV-2__KC762666__SS-prME
acugcagguauaauuaucaugaugaucccaacagugauggcguuccauuuaaccacacgcaacggagaaccacacaugaucgucaguagacaagagaaagggaaaagucuucuguuuaaaacagagaacggugugaacauguguacccucauggccauggaucuuggugaacugugugaagacacaaucacuuacaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacggaaacauggaugucaucagaaggggccuggaaacaugcccagagaauugaaacuugggucuugagacauccaggcuucaccauaauggcagcaauccuggcauauaccauaggaacaacauauuuccaaagaguccugauuuucauuuuacugacagccgucacucccucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaacgaagaacaggacaaaagguucgucugcaaacacuccaugguagacagaggauggggaaauggaugcggauuauuuggaaagggaggcaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguuguuguuuuaggaucccaagaaggggcuaugcauacagcacucacaggggccacggaaauucagaugucaucaggaaacuuacuguuuacaggacaucuuaagugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggacuuggaaaaaagacauguuuuaggucgcuugauuacagucaacccaauugucacagaaaaagauagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuucggagcuaucuauggggcugccuucagugggguuucauggacuaugaaaauccucauaggagucgucaucacauggauaggaaugaauucacgcagcaccucacugucugugucacuaguauuagugggggucgugacauuguaucugggagucauggugcaggccgauagugguugcguugugaguuggaaaaacaaagaacugaaaugcggcagugggauuuuuaucacagacaacgugcacacauggacagaacaauacaaauuccaaccagaauccccuucaaagcuggcuucagccauccagaaggcucaugaagaaggcauuuguggaauccgcucaguaacaagacuggagaaucugauguggaaacaaauaacaccagaauugaaucacauucuaucagaaaaugagguaaaguugacuaucaugacaggagacauuaaaggaaucaugcaggcaggaaaacgaucccugcggccucaacccacugagcugaaguacucguggaaaacauggggcaaagcgaaaaugcuuuccacagagcuucauaaccacaccuuucucauugauggccccgaaacagcagaaugucccaacgcaaacagagcuuggaauucacuagaaguugaagacuauggcuuuggaguauucaccacuaacauauggcugaaauugaaagaaaggcaggaugcauuuugugacucaaaacucaugucagcagccauaaaagacaacagagccguccacgccgauauggguuauuggauagaaagugcacucaacgacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaucauacacaaacggcaggacccuggcaucuagguaggcuugagauggacuuugauuucugcgaaggaaccacagugguggugacugaggauuguggaaauagaggacccuccuuaagaacaacuacugcuucuggaaaacucauaacagaguggugcugccgaucuugcacauuaccaccacuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucucgcccuauuagcagccuucaaagucagaccaacuuuugcggcuggacuacucuuaagaaagcugaccuccaaggaauugaugaugaccaccauaggaaucacacuccucucucagaguaccauaccagagacuauacuugaacugacugacgcguuggcuuuggggaugaugguucucaaaauagugagaaacauggaaaaguaccaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuugcguugacgaucaaaggccucaauccaacagccauuuucuuaacaacccucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaaaaaugaagaagaagaacaaacacugaccauacucauuagaacaggacugcuggugauaucaggacuuuuuccuguaucaauaccaaucacagcagcugcaugguaccugugggaagugaaaaaacaacgggcaggaguauugugggaugucccuucacccccaccugugggaaaggccgaacuggaagauggagccuauagaaucaagcagaaagggauccuaggauacucgcagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaaccagcacuggaaccauaggcgccgugucucuggacuuuucuccuggaacgucaggaucuccaaucgucgacaaaaaaggaaaaguugugggccuuuauggcaacggugucgucacaaggaguggaacauaugugagugccauagcccagacugaaaagagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagccaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugguauuuucaugacagcuaccccuccuggaagcagagacccauuuccucagagcaaugcaccaaucauggaugaagaaagagaaaucccugagcguucguggaacucuggacaugaguggguuacggacuuuaaagggaagacuguuugguuuguuccaaguauaaaagcagggaaugauauagcagcuugccugagaaagaauggaaagaaggugauacaacucagcaggaagacuuuugauuuugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuuuuggauaacaucaacacgccugaaggaaucauucccagcauguucgaaccagaacgugaaaagguggaugccauugauggugaauaccgcuugagaggagaagcgaggaaaacuuuuguggaccuaaugagaagaggagaucuaccagucuggcuagccuacagaguggcagcugaagguaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguagacucccaaccuucaugacccagaaagcaaggaaugcacuggacaacuuagcaguccugcauacggcugaagcaggcggaagggcguacaaucaugcucuuagugaacugccggagacucuggaaacauugcuuuuacugacacuuuuggccacagucacgggcggaaucuuccuguucuugaugagcggaaaagguauagggaagaugacccugggaaugugcugcauaaucacggcuaguauucuccuaugguaugcacaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaaccauggcaaacgagauggguuuccuggaaaaaacaaagaaagauuucggauugggaagcauaacaacccagcaaccugagaguaacauccuggacauagaucuacguccugcaucagcuuggacucuauaugccguggcaacaacuuucaucacaccaauguugaggcauaguauugaaaauuccucagugaaugugucucuaacagccauugccaaccaagccacaguguuaaugggucuugggaaaggauggccauuaucaaaaauggacaucggaguuccccuucucgcuaucgggugcuauucacaagucaaccccauaacucucacagcagcccuucucuuauugguagcacauuaugcuaucauagggccaggacuccaagcgaaagcaaccagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuccucuuuucuaucaugaaaaacacggccaacacaagaaggggaacuggcaacacaggagagacgcuuggagagaaauggaaaaaucgguugaaugcauugggaaagagugaauuccagaucuauaagaaaaguggaauccaggaaguagauagaaccuuagcaaaagaaggcaucaaaagaggagaaacagaccaucacgcugugucgcgaggcucagcgaaacugagaugguucgucgagagaaaccugguuacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacuuugcugugugacauaggggagucgucaccaaacccuacgguugaggcaggacgaacacucagaguucuaaacuuaguggaaaauuggcugaauaacaacacccaauuuugcauaaagguucucaacccauacaugcccucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacgagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacaaauggcaaugacagacacgacuccauuuggacaacagcgcgucuucaaagagaaaguggacacaagaacccaagaaccgaaagaaggcacaaaaaaacuaaugaaaaucacggcagaauggcucuggaaagaacuaggaaagaaaaagacaccuaggaugugcacuagagaagaauucacaagaaaggugagaagcaaugcagccuuaggugccauauucacugaugagaacaaguggaagucagcacgugaggcuguugaagacaguggauuuugggaauugguugacaaggaaaggaaccuccaucuugaaggaaagugugagacauguguguauaacaugaugggaaagagagagaaaaaacuaggggaguucggcaaagcaaaaggcagcagagccauaugguacauguggcuuggagcacgcuucuuagaguucgaagcucuaggauuccugaaugaagaucacugguuuuccagagagaacucccugaguggaguggaaggagaaggacugcacaaacuaggcuacauuuuaagagacgugaguaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucacuaacauggaagcccaacugaucagacagauggaaggagaaggagucuucaaaagcauccagcaacugacagucacagaagaaauugcagugaaaaacugguuagugagaguggggcgugagagguuaucaagaauggcuaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccgggugguccuugcgggaaacagccuguuugggaaaguccuacgcccaaauguggagccugauguacuuccacagacgugaccuuagacuggcggcaaaugccauuugcucggcaguuccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggcuaccugggcaaagaacauccaaacagcaauaaaucaagucagaucccuaauaggcaaugaggaauacacagacuacaugccauccaugaaaagauucagaagagaagaggaagaggcaggagucuugugguag

SEQ ID NO: 7056 - RNA, 9876 nt, Artificial Sequence
  derived and/or modified CDS sequence (wt) from DENV-2__KC762677__SS-prME
acugcagguauaauuauuaugaugauuccaacagugauggcguuccauuuaaccacacgcaauggagaaccacacaugaucgucaguagacaagagaaagggaaaagucuucuguuuaaaacagagaacggugugaacauguguacucucauggccauggaccuuggugaacugugugaagacacaaucacuuauaauuguccucuccucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcuuacacuauaggaacgacacauuuccaaagaguccugaucuucaucuuacugacagcugucgcuccuucaaugacaaugcguugcauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaagggaaaauugugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuaugguacuguuacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggcuaugcacacagcacucacaggggccacggaaauccagaugucaucaggaaacuuacuguucacuggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccauguaagaucccuuuugaaauaauggauuuggaaaaaagacauguccuaggucgcuugauuacagucaacccaauugucacagaaaaagacagcccagucaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuugggagggguguucacauccauaggaaaggcccuccaccaagucuuuggagcaaucuauggggcugccuucagugggguuucauggacuaugaaaauccucauaggagucgucaucacauggauaggaaugaauucacgcagcacuucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggccucagcuauccagaaggcucacgaagaaggcauuuguggaauccgcucaguaacaagacuggagaaucugauguggaaacaaauaacaccagaacugaaucacauucuaucagaaaaugaggugaaguugacuaucaugacaggagacauuaaaggaaucaugcaggcaggaaaacgaucccugcggccucaacccacugagcugaaguacucuuggaaaacauggggcaaagcgaaaaugcucuccacagagcuucacaaccacaccuuucucauugauggccccgaaacagcagaaugucccaacacaaacagagcuuggaacucacuagaagucgaagacuauggcuuuggaguauucaccaccaacauauggcugaaauugaaagaaaggcaggauguauauugugacucaaaacucaugucagcagccauaaaagauaacagagccguccacgccgauauggguuauuggauagaaagcgcacucaaugacacauggaagauugagaaagccucuuuuauugaaguuaaaagcugcuacuggccaaagucacacacccucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaaccacagugguggugacugaggacuguggaaauagaggacccucuuuaagaacaacuacugcuucuggaaaacucauaacagaguggugcugccgaucuugcacauuaccaccacuaagguacagaggugaggauggaugcugguauggaauggaaauuagaccaaugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggauuacucuuaagaaagcugaccuccaaggaauugaugaugaccaccauaggaaucgugcuccucucccagagcaccauaccagagacuauacuugaacugacugacgcauuggcuuuggggaugauggcucucaaaauagugagaaacauggaaaaguaucaacuagcagugacuaucauggccaucuugugcguuccaaaugcagugauauuacaaaacgcauggaaagugagcugcacaacacuggcagugguguccguuuccccacugcuuuuaacauccucacagcagaaagcggauuggauaccacuggcguugacgaucaaaggccuuaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacguacucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuagugauaucaggacuuuuuccuguaucaauaccaaucacggcagcugcaugguaccugugggaagugaaaaaacaacgagcaggaguauugugggauguccccucacccccaccugugggaaaggccgaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaaguuagaaggagaauggaaagaaggagaagaaguccagguccuggcauuagagccuggaaagaauccaagagcuguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaacggugucguuacaaggaguggaacauaugugagugcuauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaacuugauuaucauggaugaagcccauuucacagacccagcaagcauagcagcuagaggauacauuucaacucgaguagagaugggugaagcagcugggauuuucaugacagcuaccccuccuggaaguagagacccauuuccucagagcaaugcaccaaucauggaugaagaaagggaaaucccugagcguucguggaacucuggacaugaauggguuacggauuuuaaagggaagacuguuugguuuguuccaagcauaaaagcagggaaugauauagcagcuugccugagaaagaauggaaagaaagugauacaacucagcaggaagacuuuugauuuugaauauauuaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaaaaugcuucuagacaacaucaacacgccugaaggaaucauucccagcauguucgaaccagagcgugaaaagguggaugccauugauggugaauaccgcuugagaggagaagcaagaaaaacuuuuguggaccuaaugagaagaggagaccuaccagucugguuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauugaaacccagaugguuggaugcuaggaucuauucugacccacuggcgcucaaagaauucaaggaauucgcagcuggaagaaagucccugacccugaaucuaaucacagagauggguaggcucccaaccuucaugacccagaaagcaaggaaugcacuggacaacuuagcagucuugcauacagcugaagcaggcggaagggcguacaaccaugcucuuagugaacugccggagacucuggagacauugcuuuuacugacacucuuggccacagucacgggcggaaucuuccuguucuugaugaguggaaaggguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaaugagauggguuuccuggaaaaaacaaagaaagauuucggauugggaagcauuacaacccagcaaccugagagcaauauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacagcagcccuucucuuauugguagcacauuaugcuaucauagggccaggacuccaagcgaaagcaacuagagaggcucaaaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccaggaagauucuggaauacaacuauugcagugucaauggcuaacauuuuuagagggaguuacuuggccggagccggacuucucuuuucuaucaugaagaacacggcuaacacaagaaggggaacuggcaacacaggagagacgcuuggagagaaauggaaaaaccgguugaaugcauuggggaagagugaauuccagaucuauaaaaaaaguggaauccaggaaguggauagaaccuuggcaaaagaaggcaucaaaagaggagaaacagaccaucacgcugugucgcgaggcucggcgaaacugagaugguucgucgagagaaaccuggucacaccagaagggaaaguaguggaccuugguugcggcagggggggcuggucauacuauugugggggacuaaagaauguaaaagaagucaaaggccuaacaaaaggaggaccaggacacgaagaacccauucccaugucaacauauggcuggaaucuggugcgucuucaaaguggaguugauguuuuuuucacuccgccagaaaagugugauacauugcugugugacauaggggagucgucaccaaaccccacgguugaagcaggacgaacucucagaguucuaaacuuaguggaaaauuggcugaacaacaacacccaauuuugcauaaagguucucaacccauauaugcccucaguuauagaaaaaauggaagcacuacaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagauguugaccucggaaguggaacccgcaacaucggaauugaaagugagauaccaaauuuagacauaauugggaaaagaauagaaaaaauaaaacaagagcaugaaacaucauggcauuaugaccaagaucacccauacagaacgugggccuaucauggcagcuacgaaaacaaacagacuggaucagcaucauccauggugaacggagugguuagguugcuaacaaaaccuugggacguuaucccuauggugacacagauggcaaugacagauacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagaaaagaauucacaagaaaggugagaaguaaugcagccuuaggcgccauauucacugaugagaacaaguggaagucggcacgugaggcuguugaagacaguggauuuugggaauugguugacaaggaaaggaaucuccaucuugaaggaaagugugagacauguguauauaacaugaugggaaagagagagaagaagcuaggggaguucggcaaagcgaaaggcagcagagccauaugguacauguggcuuggagcacgcuucuuagaguuugaagcccuaggauucuugaacgaagaucacugguuuuccagagagaacucccugaguggaguggaaggagaagggcugcacaaacuaggcuacauuuuaagagacgugaguaagaaagaaggaggagcaauguacgcugaugacaccgcaggaugggacacaagaaucacauuagaggacuuaaaaaacgaagaaauggugacaaaccacauggaaggagaacacaagaaacuugcugaagccaucuucaaauuaacguaccaaaacaagguggugcgugugcaaagaccaacgccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcaauugacagucacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugccuuuuuguucacaccauuuccaugaguuaaucaugaaggacggucguguacucguaguuccaugcagaaaucaagaugaacugauugguagggcccgaauuucccagggagccgggugguccuugcgggaaacagccuguuuggggaagucuuacgcccaaauguggagccugauguacuuccacagacgugaccuuaggcuggcagcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaauuccauauuuggggaaaagagaagaccaauggugcggcucauuaauugggcuaacaagcagggccaccugggcaaagaacauccaaacagcaauaaaccaaguuagaucccuaauaggcaaugaggaauacacagacuacaugccauccaugaaaagauuuagaagggaagaggaagaggcaggagucuugugguag

SEQ ID NO: 7057 - RNA, 9876 nt, Artificial Sequence
  derived and/or modified CDS sequence (wt) from DENV-2__KC762668__SS-prME
acugcagguauaaucauuauggugauuccaacagugauggcguuccauuuaaccacacgcaacggagaaccacacaugaucgucaguagacaagagaaagggaaaagucuucuguuuaaaacagagaacggugugaacaugugcacccucauggccauggaccuuggugaacugugugaagacacaaucacuuacaauuguccucuucucaggcagaaugaaccagaagacauagacuguuggugcaacucuacgucuacauggguaacuuaugggacaugcaccgcuacaggagaacacagaagggaaaaaagaucaguggcacucguuccacaugugggaaugggacuggagacacgaacugaaacauggaugucaucagaaggggccuggaaacaugcacaaagaauugaaacuugggucuugagacauccaggcuucaccauaauggcagcaauccuggcauacaccauaggaacgacauacuuccaaagaguccugauuuucaucuuacugacagcugucgcuccuucaaugacaaugcguugcauaggaauaucaaauagagacuuuguggaagggguuucaggaggaagcuggguugacauaguuuuggaacauggaagcugugugacgacgauggcgaaaaauaaaccaacauuggauuuugaacugauaaagacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggagggaaaaaucgugcagccagaaaaccuggaguacaccauugugauaacaccucacucaggggaagagaaugcagucggaaaugacacaggaaaacacggcaaggaaauuaaaauaacaccacagaguuccaucacagaagcagaacuaacaggcuauggcacuguuacgauggaaugcucuccgagaacgggacucgacuucaaugagaugguguugcugcaaauggaaaacaaggcuuggcuggugcacaggcaaugguucuuagaccugccauuaccauggcugcccggagcagacacacaaggaucaaauuggauacagaaggagacauuggucacuuucaaaaauccccacgcaaagaaacaggauguuguuguuuuaggaucccaagaaggggcuaugcacacagcacucacaggggccacggaaauccagaugucaucaggaaacuuacuguucacaggacaucuuaaauguaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggauuuggaaaaaagacaugucuuaggccgcuugauuacagucaacccaauugucacagaaaaagacagcccagucaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggaccaugaaaauccucauaggaguugucaucacauggauaggaaugaauucacgcagcaccucacugucugugucacuaguauuagugggagucgugacauuguauuugggaguuauggugcaggccgauagugguugcguugugagcuggaaaaacaaagaacugaaauguggcagugggauuuuuaucacagacaacgugcacacauggacagaacaauacaaauuucaaccagaauccccuucaaagcuggcuucagcuauccagaaggcucaugaagaaggcauuuguggaauccgcucaguaacaagacuggagaaucugauguggaaacaaauaacaccagaacugaaucacauucuaucagaaaaugaggugaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucacuagagguugaagacuauggcuuuggaguauucaccaccaacauauggcugaaauugaaagaaaggcaggauguauuuugugacucaaaacucaugucagcagccauaaaagacaacagagccguccacgccgacauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaaccacagugguggugacugaggacuguggaaauagaggacccucuuuaagaacaacuaccgcuucuggaaaacucauaacagaauggugcugccgaucuugcacauuaccaccgcuaagguacagaggugaggauggaugcugguauggaauggaaaucagaccauugaaggagaaagaagagaauuuggucaacucuuugguuacagccggacauggacagauugacaacuucucacuaggagucuugggaauggcauuguuccuggaagagaugcucagaacccgaguaggaacgaaacaugcaauauuacuaguugcagucucuuucgugacauugaucacagggaacauguccuuucgagauuuggggagagugauggucaugguaggcgcuacuaugacggaugacauaggcaugggcgugacuuaucuugcccuauuagcagccuucaaggucagaccaacuuuugcagcuggacuacucuuaagaaagcugaccuccaaagaauugaugaugaccaccauaggaaucguacuccucucucagagcaccauaccagagacuauacuugaacugacugacgcguuggcuuuggggaugaugguucucaaaauaguaagaaacauggaaaaguaucaacuagcagugacuaucauggcuaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacccucucaagaacuaguaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuagagagagcugcugacguaagaugggaagaacaggcagagauaucaggaagcaguccaauucugucgauaacaauaucggaagaugguagcaugucgauaaaaaaugaagaagaagaacaaacacugaccauacugauuagaacaggacugcuggugauaucaggacuuuuucccgugucaauaccaaucacggcagcugcaugguaccugugggaagugaaaaaacaacgagccggaguguugugggaugucccuucgccuccaccugugggaaaggccgaacuggaagauggagccuauagaaucaagcagaaagggauucuaggauacucgcagaucggagccggagucuacaaagaaggaacauuccacacaauguggcaugucacacguggugcuguucuaaugcauaaagggaagagaauugaaccaucaugggcggacgucaagaaagaccuaauaucguauggaggaggcuggaagcuagaaggagaauggaaggaaggagaagaaguccaggucuuggcauuagagccuggaaagaauccaagagccguccaaacaaaacccggucuuuuuaaaacuaacacuggaaucauaggcgccgugucucuggacuuuucuccuggaacgucaggaucuccaauugucgacaaaaaaggaaaaguugugggccuuuauggcaacggugucgucacaaggaguggaacauaugugagugccauagcccagacugaaaaaagcauugaagacaacccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacuggacgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauuuccucagagcaacgcaccaaucauggaugaagaaagggaaauuccugaacguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauuuugaauauaucaagacuaggaccaaugauugggacuuuguggucacgacagacauuucagaaaugggugcuaacuucaaggcugagaggguuauagaccccagacgcugcaugaaaccagucauacuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugaugaagacugcgcacacuggaaagaagcuaagaugcuucuagauaacaucaacacgccugaaggaaucauucccagcauguucgaaccagagcgugaaaaggucgacgccauugauggugaauaccgcuugagaggagaagcgaggaaaacauuuguggaccuaaugagaagaggagaccuaccagucuggcuagccuauagaguggcagcugaagguaucaacuacgcagacagaagauggugcuuugauggagucaagaacaaccaaaucuuggaagaaaauguggaaguagaaauuuggacaaaagaaggagaaaggaagaaauuaaaacccagaugguuagaugcuaggaucuacucugacccacuggcacucaaagaauucaaggaauucgcagcuggaagaaaaucccugaccuugaaucuaaucaccgagauggguaggcucccaaccuucaugacccagaaagcaaggaaugcacuggacaacuuagcaguccugcauacagcugaagcaggcggaagggcauacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggccaguauucuccuaugguaugcacaaauacagccacauuggauagcagcuucaauaauacuggaguuuuuucuaauagucuugcucauuccagaaccagaaaagcagagaacaccccaagacaaccaauuaacuuaugucgucauagccauccuuacagugguggccgcaaccauggcaaacgagauggguuuccuggaaaaaacaaagaaagauuucggauugggaagcauuacaacccagcaacuugagagcaacauccuggacauagaucuacguccugcaucagcuuggacucuauaugccguggcaacaacuuucaucacaccaauguugagacauagcauugaaaauuccucagugaaugugucucuaacagccauugccaaucaagccacaguguuaaugggucuugggaaaggauggccauugucgaaaauggacaucggaguuccccuucucgcuaucggaugcuacucacaagucaaccccauaacucucacagcagcccuucucuuauugguagcacauuacgcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcucuaugugaggcccuaaccuuagcgaccgggcccaucucuacacugugggaaggaaauccagggagauuuuggaauacaacuauugcagugucaauggcuaacauuuuuagagggaguuaccuggccggagcuggacuucucuuuucuaucaugaagaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaaggcaucaagagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgucuucaaaguggagucgaugucuuuuuuacuccgccagaaaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaauagauucacaaugagacacaagaaggccacauacgagccagauguugaucucggaaguggaacccgcaacaucggaauugaaagugagacaccaaaucuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuaugguaacacagauggcaaugacagacacgacuccauuuggacaacagcgcguuuucaaagagaaaguggacacgagaacccaagaaccgaaagagggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucgguaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuugaaaaaugaagaaauggugacaaaccacauggaaggagaacacaagagacuugccgaagccauuuucagauuaacguaccaaaacaaaguggugcgugugcaaagaccgacaccaagaggcacaguaauggacaucauaucgagaagagaccaaagagguaguggacaaguugucaccuacggccucaauacuuucaccaacauggaagcccaacugaucagacagauggagggagaaggagucuucaaaagcauccagcaccugacagucacagaagaaauugcagugaaaaacugguuagcaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacuuguaguuccauguagaaaccaagaugaacugauugguagggcccgaauuucccagggagccgggugguccuugcgggaaacagccuguuuggggaagucuuacgcccaaauguggagccugauguacuuccacagacgugaccuuagguuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggcuaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7058 - RNA, 9876 nt, Artificial Sequence
  derived and/or modified CDS sequence (wt) from DENV-2__KC762678__SS-prME
acugcaggcauaauuaucaugaugaucccaacagugauggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacggaaacauggaugucaucagaaggggccuggaaacaugcccagagaaucgaaacuugggucuugagacauccaggcuucaccauaauggcagcaauccuggcauauaccauaggaacaacauauuuccaaagaauccugauuuucauuuuacugacagcugucacucccucaaugacaaugcguuguauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacauccugcuacucuaaggaaguauuguauagaggcaaagcugaccaacacaacaacagcaucucgcugcccaacacaaggagaaccuagccuaaacgaagaacaggacaaaagguucgucugcaaacacuccaugguagacagaggauggggaaauggaugcggauuauuuggaaaaggaggcaucgugaccugugcaauguucacaugcaaaaagaacauggaaggaaaaaucgugcaaccagaaaacuuagaguacaccauugugauaacaccucacucaggggaagagaaugcagucggaaaugacacaggaaaacacggcaaggaaauuaaaguaacaccacagaguuccaucacagaagcagagcuaacaggcuauggcacugucacgauggaaugcucuccgagaacgggccucgacuucaaugagaugguguugcugcaaauggaaaauaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguuguuguuuuaggaucccaagaaggggcuaugcauacagcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaagaucccuuuugaaauaauggacuuggaaaaaagacauguuuuaggucgcuugauuacagucaacccaauugucacagaaaaagauagcccagucaacauagaagcagaaccuccauucggagacagcuacaucauuauaggaguggaaccgggacaacugaagcucagcugguuuaagaaaggaaguucuauuggccaaauguuugagacaacaaugagaggagcgaaaagaauggccauuuuaggugacacagcuugggauuuuggaucccugggaggaguguucacaucuauaggaaaggcccuccaccaagucuucggagcuaucuauggggcugccuucagugggguuucauggaccaugaaaauccucauaggagucgucaucacauggauaggaaugaauucacgcagcaccucacugucugugucacuaguauuagugggggucgugacauuguauuugggagucauggugcaggccgauagcgguugcguugugaguuggaaaaacaaagaacugaaauguggcagugggauuuuuaucacagacaacgugcacacauggacagaacaauacaaauuccaaccagaauccccuucaaagcuggcuucagccauccagaaggcucaugaagaaggcauuuguggaauccgcucaguaacaagacuggagaaucugauguggaaacaaauaacaccagaauugaaucacauucuaucagaaaaugagguaaaguugacuaucaugacaggagacauuaaaggaaucaugcaggcaggaaaacgaucccugcggccucaacccacugagcugaaguacucguggaaaacauggggcaaagcgaaaaugcuuuccacagagcuucauaaccacaccuuucucauugauggccccgaaacagcagaaugucccaacgcaaacagagcuuggaauucacuagaaguugaagacuauggcuuuggaguauucaccaccaacauauggcugaaauugaaagaaaggcaggaugcauuuugugacucaaaacucaugucagcagccauaaaagacaacagagccguucacgccgauauggguuauuggauagaaagcgcacucaacgacacauggaagauugagaaagcuucuuuuauugaaguuaaaagcugccacuggccaaagucacacacucucuggaguaauggagugcuggaaagugagaugauaauuccaaagaauuuugcaggaccagugucacaacacaauuacagaccaggcuaucauacacaaacggcaggacccuggcaucuagguaggcuugagauggacuuugauuucugcgaaggaaccacagugguggugacugaggauuguggaaauagaggacccuccuuaagaacaacuacugcuucuggaaaacucauaacagaguggugcugccgaucuugcacauuaccaccacuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugauauaggcauaggcgugacuuaucuugcccuauuagcagcauucaaagucagaccaacuuuugcggcuggacuacucuuaagaaagcugaccuccaaggaauugaugaugaccaccauaggaaucacacuccucucucagaguaccauaccagagacuauacuugaacugacugacgcguuggcuuuggggaugaugguucucaaaauagugagaaacauggaaaaguaccaacuagcagugacuaucauggccaucuugugcgucccaaaugcagugauauuacaaaacgcauggaaagugagcugcacaacauuggcagugguguccguuuccccacugcuuuuaacauccucacagcagaaagcggauuggauaccacucgcguugacgaucaaaggccucaauccaacagccauuuucuuaacaacccucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacguacucacuggaagaucggcugauuuggaacuggaaagagcugcugacguaagaugggaagaacaggcagagauaucaggaaguaguccaauucucucgauaacaauaucggaagaugguagcaugucgauaaaaaaugaagaagaagaacaaacacugaccauacucauuagaacaggacugcuggugauaucaggacuuuuuccugugucaauaccaaucacagcagcugcaugguaccugugggaagugaaaaaacaacgggcaggaguauugugggaugucccuucacccccaccugugggaaaggccgaacuggaagauggagccuauagaaucaagcagaaagggauccuaggauacucgcagauuggagccggaguuuacaaagaaggaacauuccacacaauguggcaugucacacguggugcuguccuaaugcauaaagggaaaagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaaccagcacuggaaccauaggcgccgugucucuggacuuuucuccuggaacgucaggaucuccaaucgucgacaaaaaaggaaaaguugugggccuuuauggcaacggugucgucacaaggaguggaacauaugugagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggguugagaacgcuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugguauuuucaugacagcuaccccuccuggaagcagagacccauuuccucagagcaaugcaccaaucauggaugaagaaagagaaaucccugagcguucguggaacucuggacaugaguggguuacggacuuuaaagggaagacuguuugguuuguuccaaguauaaaagcagggaaugauauagcagcuugccugagaaagaauggaaagaaggugauacaacuuagcaggaagacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugauccuggcaggacccaugccagugacccacucuagugcagcacaaagaagagggagaguaggaagaaauccaaaaaaugaaaaugaccaguacauauacaugggggaaccucuggaaaaugacgaagacugugcacacuggaaagaagcuaagaugcuuuuggauaacaucaacacgccugaaggaaucauucccagcauguucgaaccagaacgugaaaagguggaugccauugauggugaauaccgcuugagaggagaagcgaggaaaacuuuuguggaccuaaugagaagaggagaucuaccagucuggcuagccuacagaguggcagcugaagguaucaacuacgcagacagaagauggugcuuugauggagucaagaauaaccaaaucuuggaagaaaauguggaaguagaaauuuggacaaaagaaggagaaaggaagaaauuaaaacccagaugguuggaugcuaggaucuacucugacccacuggcgcucaaagaauucaaggaauucgcagcuggaagaaagucccugacccugaaucuaaucacagagauggguagacucccaaccuucaugacccagaaaguaaggaaugcacuggacaacuuagcaguccugcauacggcugaagcaggcggaagggcguacaaccaugcucuuagugaacugccggagacucuggaaacauugcuuuuacugacacuuuuagccacagucacgggcggaaucuuccuguucuugaugagcggaaaagguguaggaaagaugacccugggaaugugcugcauaaucacggcuaguauucuccuaugguaugcgcaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauaguauugaaaauuccucagugaaugugucucuaacagccauugccaaccaagccacaguguugaugggucuugggaaaggauggccauuaucaaaaauggacaucggaguuccccuucucgccaucgggugcuauucacaagucaaccccauaacucucacagcagcccuucucuuauugguagcacauuaugcuaucauagggccaggacuccaagcgaaagcaaccagagaagcccagaaaagaacagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcccuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaucgguugaaugcauugggaaagagugaauuccagaucuauaagaaaaguggaauccaggaaguagauagaaccuuagcaaaagaaggcaucaaaagaggagaaacagaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaaccuauucccaugucaacauaugguuggaaucuggugcgucuucaaaguggaguugauguuuuuuuuacuccgccagaaaagugugacacuuugcugugugacauaggggagucgucaccaaacccuacgguagaggcaggacgaacacucagaguucuaaacuuaguggaaaauuggcugaauaacaacacccaauuuugcauaaagguucucagcccauacaugcccucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcuucuaacaaaaccuugggacgucaucccuauggugacacaaauggcaaugacagacacgacuccauuuggacaacagcgcgucuucaaagagaaaguggacacaagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacagcggauuuugggaauugguugacaaggaaaggaaccuccaucuugaaggaaagugugagacauguguguauaacaugaugggaaagagagagaaaaaacuaggggaguucggcaaagcaaaaggcagcagagccauaugguacauguggcuuggagcacgcuucuuagaguucgaagcucuaggauuccugaaugaagaucacugguuuuccagagagaacucccugaguggaguggaaggagaaggacugcacaaacuagguuacauuuuaagagacgugaguaagaaagaaggaggagcaauguaugccgaugacaccgcaggaugggacacaagaaucacacuagaggacuuaaaaaaugaagaaauggugacaaaucacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucacuaacauggaagcccaacugaucagacagauggaaggagaaggagucuucaaaagcauccagcaacugacagucacagaagaaauugcagugaaaaacugguuagugacaguggggcgugagagguuaucaagaauggcuaucaguggagaugauuguguugugaaacccuuagaugacagguucgcaagugcucuaacagcucuaaaugacaugggaaagguuaggaaagacauacaacaaugggaaccuucaagaggauggaacgauuggacacaagugcccuuuuguucacaccacuuccaugaguuaaucaugaaggacggucguguacucguaguuccaugcagaaaccaagaugaacugauugguagggcccgaauuucccagggagccgggugguccuugcgggaaacagccuguuuggggaaguccuacgcccaaauguggagccugauguacuuccacagacgugaccuuagacuggcggcaaaugccauuugcucggcaguuccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggcuaccugggcaaagaacauccaaacagcaauaaaucaagucagaucccuaauaggcaaugaggaauacacagacuacaugccauccaugaaaagauucagaagagaagaggaagaggcaggagucuugugguag

SEQ ID NO: 7059 - RNA, 9876 nt, Artificial Sequence
  derived and/or modified CDS sequence (wt) from DENV-2__KC762679__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacugcuggugcaacucuacgucuacauggguaacuuacgggacaugcaccgccacaggagaacacagaagggaaaaaagaucaguggcacucguuccacaugugggaaugggacuggagacacgaacugaaacauggaugucaucagaaggggccuggaaacaugcccagagaauugaaacgugggucuugagacauccaggcuucaccauaauggcagcaauccuggcuuacaccauaggaacgacauauuuccaaagaguccugaucuucaucuuacugacagcuguugcuccuucaaugacaaugcguuguauaggaauaucaaauagagacuuuguggaagggguaucaggaggaagcuggguugacauagucuuggaacauggaagcugugugacgacgauggcaaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggagguaucgugaccugugcaauguucacaugcaaaaagaacauggaaggaaaaaucgugcaaccagaaaaccuggaguacaccauugugauaacaccucacucaggggaagagaaugcagucggaaaugacacaggaaaacacgguaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggccaugcacacagcacucacaggggccacggaaauccagaugucaucaggaaacuugcuguucacaggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccgugcaagauccccuuugaaauaauggauuuggaaaaaagauaugucuuaggucgcuugauuacagucaacccaauugucacagaaaaagacaguccagucaacauagaagcagaaccuccauucggggacagcuauaucauuauaggaguagaaccaggacaauugaagcucaacugguuuaagaaaggaaguucuauuggccaaauguuugagacaacaaugagaggagcgaagagaauggccauuuuaggugacacagcuugggauuuuggauccuugggagggguguucacauccauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuagagaaucugauguggaaacaaauaacaccagaacugaaucacauucuaucagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuccucauugauggccccgaaacagcagaaugucccaacacaaacagagcuuggaacucacuagaaguugaagacuauggcuuuggaguauuuaccaccaacauauggcugaaauugaaagaaaggcaggauguauuuugugacucaaaacucaugucggcagccauaaaagacagcagagccguccacgccgauauggguuauuggauagaaagcgcacucaacgacacauggaagauugagaaagccucuuuuauugaaguuaaaagcugccacuggccaaagucacacacucucuggagcaauggagugcuagaaagugagaugauaauuccaaagaacuuugcaggaccagugucacaacacaauuacagaccaggcuaucauacacaaacggcaggacccuggcaucuaggcaggcuugagauggacuucgauuucugcgaaggaaccacagugguggugacugaggacuguggaaauagaggaccuucuuuaagaacaacuacugcuucuggaaaacucauaacagagugguguugccgaucuugcacauuaccaccgcuaagguacagaggugaggauggaugcugguauggaauggaaauuagaccauugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaaucgugcuccucucccaggccaccauaccagagacuauacuugaacugacugacgcguuggcuuuggggaugaugguucucaaaauagugagaaacauggaaaaguaucaacuagcagugacuaucauggccauuuugugcgucccaaaugcagugauauuacaaaaugcauggaaagugagcugcacgacacuggcagugguguccguuuccccacugcuuuuaacauccucacagcagaaagcggauuggauaccacuggcgcugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuggugauaucaggacuuuuucccgugucaauaccaaucacggcagcugcaugguaccugugggaagugaaaaaacaacgagcaggaguauugugggaugucccuucacccccaccugugggaaaggccgaacuggaagauggagccuacagaaucaagcagaaagggauucuaggauacucgcagaucggagcuggaguuuacaaagaaggaacuuuucacacaauguggcaugucacacguggugcuguccuaaugcauaaagggaagagaauugaaccaucaugggcggacgucaagaaagaucuaauaucguauggaggaggcuggaagcuagaaggagaauggaaggaaggagaagaaguccagguccuggcauuagagccuggaaagaauccaagagccguccaaacaaaacccggucuuuuuaaaacuaauacuggaaccauaggugccgugucucuggacuuuucuccuggaacgucaggaucuccaaucgucgacaaaaaaggaaaaguggugggccuuuauggcaacggugucguuacaaggaguggaacauaugugagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagagugguggcggcugaaauggaagaagcucucagaggacuuccaauaagauaccaaaccccagcuauuagagcugagcacacugggcgggagauuguggaucuaaugugucacgccacauuuaccaugaggcugcuaucaccaauuagagugccaaauuauaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaaugcaccaaucauggaugaagaaagggaaaucccugagcguucguggaacucuggacaugagugggucacggauuucaaagggaagacuguuugguuuguuccaagcauaaaagcagggaaugacauagcagcuugccugagaaagaauggaaagaaagugauacaacucagcaggaagacuuuugacucugaauauauaaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaaaaugcuucuagacaacauuaacacgccugaaggaaucauucccagcauguucgaaccagagcgugaaaagguggaugccauugauggugaauaccgcuugagaggagaagcgaggaaaacuuucguggaccuaaugagaagaggagaccuaccagucugguuagccuacagaguggcagcugaagguaucaauuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaguucgcagcuggaagaaagucccugacacugaaucuaaucacagagauggguaggcucccaaccuucaugacccagaaagcaaggaaugcacuggauaacuuagcagucuugcauacagccgaagcaggcggaagggcguacaaucaugcucuuagugaacugccggagacucuggagacauugcuuuuacugacacucuuggccacagucacgggcggaaucuuccuguucuugaugagcggaaaagguauagggaagaugaccuugggaaugugcugcauaaucacggccagcauucuccuaugguaugcucaaauacagccacacuggauagcagcuucaauaauauuggaguuuuuucucauagucuugcucauuccagaaccagaaaagcagagaacgccccaagauaaccaauuaacuuauguugucauagccauccucacagugguggccgcaaccauggcaaacgagauggguuuucuggaaaaaacaaagaaagauuucggacugggaagcauuacaacccagcaaccugagagcaacauccuggacauagaucuacguccugcaucagcuuggacucuauaugccguggcaacaaccuucaucacaccaauguugagacauaguauugaaaauuccucagugaaugugucucuaacagccauugccaaccaagccacaguguuaaugggucuugggaaaggauggccauugucaaagauggauaucggaguuccccuucucgcuaucgggugcuauucacaagucaaccccauaacucucacagcagcccuucuccuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacuuugggaaggaaauccaggaagauucuggaauacaacuauugcagugucaauggcuaacauuuuuagagggaguuaccuggccggagccggacuucucuuuucuaucaugaagaacacggccaacacaagaaggggaacuggcaacacgggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacggaccaucaugcugugucgcgaggcucggcgaaacugagaugguucgucgagagaaaccugguuacaccagaagggaaaguaguggaccuugguuguggcaggggaggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuuuacuccaccagaaaagugugacacauugcugugugacauaggggagucgucaccaaaccccacuguugaagcaggacgaacacucagaguucuaaaccuaguggaaaauuggcugaacaauaacacccaauuuugcauaaagguucucaauccauauaugcccucagucauagaaaaaauggaagcgcuacaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggcuuaccauggcagcuacgaaacaaaacagacuggaucagcaucauccauggugaacggagugguuaggcugcuaacaaaaccuugggacguuaucccuauggugacacagauggcaaugacagacacgacuccauuuggacaacagcgcguuuucaaagagaaaguggacacgagaacccaagaaccgaaagaaggcacgaaaaaacuaaugaagaucacggcagaauggcucuggaaagaacuaggaaagaaaaagacaccuaggaugugcaccagagaagaauucacaagaaaggugagaaguaaugcagccuuaggcgccauauucacugaugagaauaaguggaagucggcacgugaggcuguugaagacagcggauuuugggaacugguugacaaagaaaggaaucuccaucuugaaggaaagugugagacaugcguauauaacaugaugggaaagagagagaagaaacuaggggaguucggcaaagcgaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaugaaagaaggaggagcaauguacgccgaugacaccgcaggaugggacacaagaaucacacuagaggacuuaaaaaaugaagaaauggugacaaaccacauggaaggagaacacaagaaacuugcugaagccaucuucaaacuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaacugacagucacagaagaaauugcagugaaaaacugguuaguaagaguggggcgugagagguuaucaagaauggccauuaguggagaugauuguguugugaaacccuuagaugacagguuugcaagcgcucuaacagcucuaaaugacaugggaaagguuaggaaagacauacaacaaugggaaccuucaagaggauggaacgacuggacacaagugccuuuuuguucacaucauuuccaugaguuaaucaugaaggacggucguguacucguaguuccaugcagaaaucaagaugaacugauugguagggcccgaauaucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcuaacaguuuggaacaggguguggauucaagaaaacccauggauggaagacaaaacuccaguggaaucaugggaggaaaucccauauuuggggaaaagagaagaccaauggugcggcucauugauugggcuaacaagcagggccaccugggcaaagaauauccaaacagcaauaaaucaaguuagaucccuaauaggcaaugaggaauacacagacuacaugccauccaugaaaagauuuagaagagaagaggaagaggcaggagucuugugguag

SEQ ID NO: 7060 - RNA, 9876 nt, Artificial Sequence
  derived and/or modified CDS sequence (wt) from DENV-2__KC762680__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuauaauuguccucuucucaggcagaaugaaccagaagacauagacugcuggugcaacucuacgucuacauggguaacuuacgggacaugcaccgccacaggagaacacagaagggaaaaaagaucaguggcacucguuccacaugugggaaugggacuggagacacgaacugaaacauggaugucaucagaaggggccuggaaacaugcccagagaauugaaacgugggucuugagacauccaggcuucaccauaauggcagcaauccuggcuuacaccauaggaacgacauauuuccaaagaguccugaucuucaucuuacugacagcuguugcuccuucaaugacaaugcguuguauaggaauaucaaauagagacuuuguggaagggguaucaggaggaagcuggguugacauagucuuggaacauggaagcugugugacgacgauggcaaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggagguaucgugaccugugcaauguucacaugcaaaaagaacauggaaggaaaaaucgugcaaccagaaaaccuggaguacaccauugugauaacaccucacucaggggaagagaaugcagucggaaaugacacaggaaaacacgguaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggccaugcacacagcacucacaggggccacggaaauccagaugucaucaggaaacuugcuguucacaggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccgugcaagauccccuuugaaauaauggauuuggaaaaaagauaugucuuaggucgcuugauuacagucaacccaauugucacagaaaaagacaguccagucaacauagaagcagaaccuccauucggggacagcuauaucauuauaggaguagaaccaggacaauugaagcucaacugguuuaagaaaggaaguucuauuggccaaauguuugagacaacaaugagaggagcgaagagaauggccauuuuaggugacacagcuugggauuuuggauccuugggagggguguucacauccauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggcuucagcuauccagaaggcucaugaagaaggcauuuguggaauccgcucaguaacaagacuagagaaucugauguggaaacaaauaacaccagaacugaaucacauucuaucagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuccucauugauggccccgaaacagcagaaugucccaacacaaacagagcuuggaacucacuagaaguugaagacuauggcuuuggaguauuuaccaccaacauauggcugaaauugaaagaaaggcaggauguauuuugugacucaaaacucaugucggcagccauaaaagacagcagagccguccacgccgauauggguuauuggauagaaagcgcacucaacgacacauggaagauugagaaagccucuuuuauugaaguuaaaagcugccacuggccaaagucacacacucucuggagcaauggagugcuagaaagugagaugauaauuccaaagaacuuugcaggaccagugucacaacacaauuacagaccaggcuaucauacacaaacggcaggacccuggcaucuaggcaggcuugagauggacuucgauuucugcgaaggaaccacagugguggugacugaggacuguggaaauagaggaccuucuuuaagaacaacuacugcuucuggaaaacucauaacagagugguguugccgaucuugcacauuaccaccgcuaagguacagaggugaggauggaugcugguauggaauggaaauuagaccauugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggacuacucuuaagaaagcugaccuccaaggaauugaugaugaccaccauaggaaucgugcuccucucccaggccaccauaccagagacuauacuugaacugacugacgcguuggcuuuggggaugaugguucucaaaauagugagaaacauggaaaaguaucaacuagcagugacuaucauggccauuuugugcgucccaaaugcagugauauuacaaaaugcauggaaagugagcugcacgacacuggcagugguguccguuuccccacugcuuuuaacauccucacagcagaaagcggauuggauaccacuggcgcugacgaucaaaggccucaauccaacagccauuuucuuaacaacccucucaagaacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuggugauaucaggacuuuuucccgugucaauaccaaucacggcagcugcaugguaccugugggaagugaaaaaacaacgagcaggaguauugugggaugucccuucacccccaccugugggaaaggccgaacuggaagauggagccuacagaaucaagcagaaagggauucuaggauacucgcagaucggagcuggaguuuacaaagaaggaacuuuucacacaauguggcaugucacacguggugcuguccuaaugcauaaagggaagagaauugaaccaucaugggcggacgucaagaaagaucuaauaucguauggaggaggcuggaagcuagaaggagaauggaaggaaggagaagaaguccagguccuggcauuagagccuggaaagaauccaagagccguccaaacaaaacccggucuuuuuaaaacuaauacuggaaccauaggugccgugucucuggacuuuucuccuggaacgucaggaucuccaaucgucgacaaaaaaggaaaaguggugggccuuuauggcaacggugucguuacaaggaguggaacauaugugagugccauagcccagacugaaaaaagcaucgaagacaauccagagauugaagaugacaucuuucgaaagaaaagauugaccaucauggaccuccacccaggagcaggaaaaacaaagagauaccuuccagcaauagucagagaagccauaaaacgaggcuugagaacacuaauccuggcccccacuagagugguggcggcugaaauggaagaagcucucagaggacuuccaauaagauaccaaaccccagcuauuagagcugagcacacugggcgggagauuguggaucuaaugugucacgccacauuuaccaugaggcugcuaucaccaauuagagugccaaauuauaaccugauuaucauggaugaagcccauuuuacagacccagcaagcauagcagcuagaggauacauuucaacucgaguagagaugggugaagcagcugggauuuucaugacagccaccccuccuggaagcagagacccauuuccucagagcaaugcaccaaucauggaugaagaaagggaaaucccugagcguucguggaacucuggacaugagugggucacggauuucaaagggaagacuguuugguuuguuccaagcauaaaagcagggaaugacauagcagcuugccugagaaagaauggaaagaaagugauacaacucagcaggaagacuuuugacuuugaauauauaaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaaaaugcuucuagacaacauuaacacgccugaaggaaucauucccagcauguucgaaccagagcgugaaaagguggaugccauugauggugaauaccgcuugagaggagaagcgaggaaaacuuucguggaccuaaugagaagaggagaccuaccagucugguuagccuacagaguggcagcugaagguaucaauuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaguucgcagcuggaagaaagucccugacacugaaucuaaucacagagauggguaggcucccaaccuucaugacccagaaagcaaggaaugcacuggauaacuuagcagucuugcauacagccgaagcaggcggaagggcguacaaucaugcucuuagugaacugccggagacucuggagacauugcuuuuacugacacucuuggccacagucacgggcggaaucuuccuguucuugaugagcggaaaagguauagggaagaugaccuugggaaugugcugcauaaucacggccagcauucuccuaugguaugcucaaauacagccacacuggauagcagcuucaauaauauuggaguuuuuucucauagucuugcucauuccagaaccagaaaagcagagaacgccccaagauaaccaauuaacuuauguugucauagccauccucacagugguggccgcaaccauggcaaacgagauggguuuucuggaaaaaacaaagaaagauuucggacugggaagcauuacaacccagcaaccugagagcaacauccuggacauagaucuacguccugcaucagcuuggacucuauaugccguggcaacaaccuucaucacaccaauguugagacauaguauugaaaauuccucagugaaugugucucuaacagccauugccaaccaagccacaguguuaaugggucuugggaaaggauggccauugucaaagauggauaucggaguuccccuucucgcuaucgggugcuauucacaagucaaccccauaacucucacagcagcccuucuccuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacuuugggaaggaaauccaggaagauucuggaauacaacuauugcagugucaauggcuaacauuuuuagagggaguuaccuggccggagccggacuucucuuuucuaucaugaagaacacggccaacacaagaaggggaacuggcaacacgggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacggaccaucaugcugugucgcgaggcucggcgaaacugagaugguucgucgagagaaaccugguuacaccagaagggaaaguaguggaccuugguuguggcaggggaggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuuuacuccaccagaaaagugugacacauugcugugugacauaggggagucgucaccaaaccccacuguugaagcaggacgaacacucagaguucuaaaccuaguggaaaauuggcugaacaauaacacccaauuuugcauaaagguucucaauccauauaugcccucagucauagaaaaaauggaagcgcuacaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggcuuaccauggcagcuacgaaacaaaacagacuggaucagcaucauccauggugaacggagugguuaggcugcuaacaaaaccuugggacguuaucccuauggugacacagauggcaaugacagacacgacuccauuuggacaacagcgcguuuucaaagagaaaguggacacgagaacccaagaaccgaaagaaggcacgaaaaaacuaaugaagaucacggcagaauggcucuggaaagaacuaggaaagaaaaagacaccuaggaugugcaccagagaagaauucacaagaaaggugagaaguaaugcagccuuaggcgccauauucacugaugagaauaaguggaagucggcacgugaggcuguugaagacagcggauuuugggaacugguugacaaagaaaggaaucuccaucuugaaggaaagugugagacaugcguauauaacaugaugggaaagagagagaagaaacuaggggaguucggcaaagcgaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaugaaagaaggaggagcaauguacgccgaugacaccgcaggaugggacacaagaaucacacuagaggacuuaaaaaaugaagaaauggugacaaaccacauggaaggagaacacaagaaacuugcugaagccaucuucaaacuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaacugacagucacagaagaaauugcagugaaaaacugguuaguaagaguggggcgugagagguuaucaagaauggccauuaguggagaugauuguguugugaaacccuuagaugacagguuugcaagcgcucuaacagcucuaaaugacaugggaaagguuaggaaagacauacaacaaugggaaccuucaagaggauggaacgacuggacacaagugccuuuuuguucacaucauuuccaugaguuaaucaugaaggacggucguguacucguaguuccaugcagaaaucaagaugaacugauugguagggcccgaauaucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcuaacaguuuggaacaggguguggauucaagaaaacccauggauggaagacaaaacuccaguggaaucaugggaggaaaucccauauuuggggaaaagagaagaccaauggugcggcucauugauugggcuaacaagcagggccaccugggcaaagaauauccaaacagcaauaaaucaaguuagaucccuaaaaggcaaugaggaauacacagacuacaugccauccaugaaaagauuuagaagagaagagggagaggcaggagucuugugguag

SEQ ID NO: 7061 - RNA, 9876 nt, Artificial Sequence
  derived and/or modified CDS sequence (wt) from DENV-2__JQ955624__SS-prME
acugcaggcgugaucaucaugcuaauuccaacagcgauggcuuuccauuuaacuacacgcaacggagaaccacacaugaucgucagcagacaagagaaagggaaaagucucuuguucaaaacagaggauggugugaacauguguacccucauggccauggaccuuggugaacugugugaagacacaaucacuuauaacuguccucuucucaggcagaaugaaccagaagauauagauuguugguguaauuccacguccacauggguaacuuacgggacaugcacugccacaggagaacauagaagggaaaaaagaucaguggcacucgucccacaugugggaaugggauuggagacacgaacugaaacauggaugucaucagaaggggccuggaaacacgcccagagaauugaaaccuggaucuugagacauccagguuuugccauaauggcagcaaucuuggcauacaccauaggaacaacacauuuccaaagaguccugaucuucaucuuacugacagcugucgccccuucaaugacaaugcguuguauuggaauaucaaauagagacuuuguggaagggguuucaggaggaaguuggguugacauagucuuagaacauggaagcugugugacaacgauggcaaaaaauaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguuuguuugcaaacauuccaugguagacagaggauggggaaauggauguggauuauuuggaaagggaggcaucgugaccugugcuauguucacaugcaaaaaaaacauggaaggaaaaauugugcaaccagaaaaucuggaauacaccauugugguaacaccucauucaggggaagagaaugcaguuggaaaugacacaggaaaacauggcaaggaaaucaaaguaacaccacagaguuccauuacagaagcagaacugacaggcuacggcacugucacgauggagugcucuccaagaacgggccucgacuucaaugaaaugguguugcugcaaauggaaaauaaggcuuggcuggugcacaggcaaugguucuuagaccugccguuaccauggcugcccggagcggacacacaaggaucaaauuggauacagaaggagacguuggucaccuucaaaaauccccaugcgaagaaacaggauguuguuguuuuaggaucccaagaaggggcuaugcauacagcacuuacaggggccacggaaauccagaugucaucaggaaaccuacuguucacaggacaucucaagugcaggcugagaauggauaaauuacagcucaaaggaaugucauacucuauguguacaggaaaguuuaaaguuguaaaggaaauagcagagacacaacauggaacaauaguugucagaguacaauaugaaggggauggcucuccauguaaaaucccuuuugagauaauggauuuggaaaaaagacaugucuuaggucgccugauuacagucaacccaaucgucacagaaaaagacaguccagucaacauagaagcagaaccuccauuuggagacagcuacaucauuauaggaguagaaccgggacaacugaagcucagcugguuuaagaaaggaagcucaaucggccaaauguucgagacaacaaugagaggagcgaagagaauggccaucuuaggugacacagccugggauuuuggaucccugggaggaguguucacaucuauaggaaaggcccuccaccaaguuuucggagcaaucuauggggccgccuucaguggggucucauggacuaugaaaauccucauaggaguugucaucacauggauaggaaugaauucacguagcaccucacugucugugucacuaguauuagugggagucgugacauuguacuugggaguuauggugcaggcugauaguggcuguguugugaguuggaaaaacaaagaauugaaauguggcagcgggauuuuuaucacagacaauguacacacauggacagaacaauacaaauuccaaccagaaucccccucaaagcuggcuucagcuauccagaaagcucaugaagagggcauuuguggaauccgcucaguaacaagacuggagaaucuaauguggaaacaaauaacaccagaacugaaucacauucuaucagaaaaugagguaaaguugacuaucaugacaggagacaucaaagguaucaugcaggcaggaaaacgaucccugcggccucagcccacugagcugaaguauucauggaaaacguggggcaaagcgaaaaugcucuccacagagucccauaaccagaccuuucucauugauggccccgaaacaacagaaugucccaacacaaacagagcuuggaacucacuagaaguugaagacuauggcuuugggguauucaccaccaacauauggcugaaguugaaagaaaggcaagauguguuuugugacucaaaacucaugucagcggccguaaaagacaacagagccguccaugccgauauggguuauuggauagaaagcgcacucaaugacacauggaagauagaaaaagcuucuuuuauugaagucaaaaguugccacuggccaaaaucacacacucucuggagcaauggagugcuagaaagugagaugauaauuccaaagaauuuugcuggaccaguaucacaacauaauuacagaccaggcuaucacacacaaacggcaggaccuuggcaccuaggcaagcuugagauggacuuugauuuuugcgaaggaacuacagugguggugacugaagacuguggaaauagaggacccucuuuaagaacaacuaccgcuucuggaaagcucauaacagaauggugcugccgauccugcacauuaccaccacuaagauacagaggugaggauggaugcugguacggaauggaaauuagaccauugaaagagaaagaagagaacuuggucaauuccuuggucacagccggacauggacagauugacaacuucucacuaggaaucuugggaauggcacuguuccuggaagaaaugcucaggacccgaguaggaacaaaacacgcaguauuacuaguugcaguuucuuucaugacauugaucacagggaacaugucuuuccgagaccuggggagagugaugguuauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaauuguacuccucucccagagcaccauaccagagaccauacuugaacugacugaugcguuggccuugggcaugaugguucucaagauagugaggaauauggaaaaguaucaguuagcagugacuaucauggcuaucuuauguguuccaaacgcaguaauauuacaaaaugcauggaaagugagcugcacaauacuggcagugguguccguauccccacugcucuuaacaucuucacagcagaaagcggauuggauaccauuggcauugacgaucaaaggucucaauccaacagccauuuuccuaacaacccuuucaagaaccaacaagaaaaggaguuggccacuaaaugaggcuaucauggcaguagggauggugagcauuuuagccaguucucucuugaagaaugacauucccaugacaggaccauuaguggcuggagggcuucucacuguguguuacgugcucacuggaagaucggccgacuuggaacuggagagagccgccgauguaagaugggaagaucaggcagagauaucaggaagcaguccaauucugucaauaacaauaucggaagauggcaguaugucgauaaaaaaugaagaggaagaacaaacacugaccauacucauuagaacaggauugcuggugauaucaggacuuuuucccguaucaauaccaaucacagcagcagcaugguaucugugggaagugaagaaacaacgggcuggaguauugugggauguuccuucacccccaccugugggaaaggccgaauuggaagauggagcuuauagaaucaagcagaaagggauucuuggauacucccagaucggagcuggaguuuacaaagaaggaacauuccacacaauguggcacgucacacguggugcuguucuaaugcauaaagggaagaggauugaaccaucaugggcggaugucaggaaagaccuaauaucguauggaggaggcuggaagcuggaaggagaauggaaggaaggagaagaaguccaggucuuggcauuagagccuggaaagaauccaagagccguccaaacaaaacccggucuuuuuaaaacuaacaccggaaccauaggugcugugucucuagacuuuucuccuggaacgucaggaucuccaauugucgacaaaaaaggaaaggucgugggucucuauggcaacggugucgucacaagaaguggaacauaugugagugccauagcccaaucugaaaaaagcauugaagacaauccagagauugaagaugauaucuuucggaaaaaaagauuaaccauuauggaccuccacccaggagcgggaaagacgaaaagauaccuuccagcaauaguuagagaggccauaaaacgaggcuuaagaacauuaauccuggcccccacuagagucguggcagcugaaauggaagaagcucuuagaggacuuccaauaagauaccaaaccccagccauuagagcugagcacacagggcgagaaaucguggauuuaaugugucaugccacauuuaccaugaggcuguuaucaccaguuagagugccaaauuacaacuugaucaucauggaugaagcccauuucacagacccagcaagcauagcagccagaggauauauuucaacucgaguggagaugggugaagcagcugggauuuuuaugacagccacuccuccaggaagcagagacccauuuccucaaagcaaugcaccaaucauggaugaagaaagggaaaucccugaacgcucguggaacucuggacaugagugggucacagauuuuaaagggaagacuguuugguuuguuccgaguauaaaagcgggaaaugauauagcagcuugccugagaaaaaauggaaagaaagugauacaacucaguaggaagaccuuugauucugaauacaucaagacuagaaccaaugauugggauuuuguggucacgacugacauuucagaaaugggugccaacuucaaggcugaaaggguuauagaccccaggcgcugcaugaaaccagucauacugacagacggugaagagcgggugauccuggcaggacccaugccagugacucacucuagugcagcacaaagaagagggagaauaggaagaaauccaaaaaaugaaaaugaccaguacauauacaugggggaaccucuggaaaaugaugaagacugugcacacuggaaagaagccaagaugcuuuuagacaacaucaacacgccugaaggaaucauucccagcauguucgaaccagagcgugaaaaaguggaugccauugauggugaauaucgcuuaagaggagaagcgaggaaaaccuuuguggagcuaaugagaagaggagaccuaccagucuggcuggccuacagaguggcagccgaaggcauuaacuaugcagacagaaggugguguuuugauggaaucaagaacaaccaaaucuuggaagaaaauguggaaguggaaaucuggacaaaagaaggggaaaggaagaaacugaaacccagaugguuggaugcuaggaucuacucugacccacuggcgcucaaagaauucaaagaguuugcagcuggaagaaaaucccugacccugaauuuaaucacagaaauggguaggcucccaacuuuuaugacucagaaagcaaggaacgcacuggauaacuuagcaguccugcauacggccgaagcaggcggaagggcguacaaucaugcucucagugaacugccagagacccuggagacacugcuuuugcugacacuuuuggccacagucacggguggaaucuuuuuauucuugaugaguggaaaagguauagggaaaaugacccugggaaugugcugcauaaucacggccagcauucuccuaugguacgcacaaauacagccacacuggauagcagcuucaauaauacuggaguuuuuucucauagucuugcucauuccagagccagaaaagcaaagaacaccccaagacaaccaauugacuuacguugucauagccauccucacagugguggcugcaaccauggcaaaugagaugggguuccuggaaaaaacgaagaaagauuucggauuuggaagcauugcaacccaacaacccgagagcaacauccuggacauagaucuacguccugcaucagcauggacccuguaugcaguggccacaacauuuaucacaccaauguugagacauagcauugaaaauucuucagugaaugugucucuaacagccauugccaaucaagccacagugcuaaugggucuugggaagggguggccauugucaaaaauggacauuggaguuccccuucucgccaucgggugcuacucacaagucaaccccauaacucucacagcagcccuucuuuuauugguagcacacuaugcuaucauagggccaggacuccaagcaaaagcaaccagagaagcgcagaaaagagcagcagcaggcaucaugaaaaacccaacuguggauggaauaacagugauugaccuagauccaauacccuaugauccaaaauuugagaagcagcugggacaaguaaugcuccuaguccucugcgugacucaaguacugaugaugaggacuacaugggcuuugugugaggcucuaaccuuagcgaccgggcccaucuccacauugugggaaggaaauccagggagauuuuggaacacaaccauugcagugucaauggcuaacauuuuuagaggaaguuaccuagcuggagcuggacuucucuuuuccaucaugaagaacacaaccaacacaagaaggggaacuggcaacacaggagagacgcuuggggagaaauggaaaaaccgauugaauucauuggggaagagugaauuccagaucuacaagagaagcggaauccaggaaguggauagaaccuuagcaaaggaaggcauuaaaagaggagaaacggaccaucacgcugugucgcgaggcucagcaaagcugagaugguucgucgagagaaaccugguuacaccagaggggaaaguaauggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugauguuuucuuuacuccgccagaaaaaugugacacauuguugugugacauaggggagucgucaccaaaucccacgguugaagcaggacgaacacuuagaguccuaaacuugguagaaaauuggcugaacaacaacacccaauuuugcauaaagguucuaaacccauacaugcccucagucaucgaaaaaauggaaacgcugcaaaggaaauacggaggagcuuuggugaggaauccacucucaaggaauuccacacaugagauguauuggguaucuaaugcuuccgggaacauagugucaucagugaacaugauuucaaggauguugaucaauagauucacaaugagacauaagaaggccacauacgagccagauguugaccucggaagcggaacccgcaacaucggaauugaaagugagacaccaaacuuagacauaauugggaaaagaauagaaaaaauaaaacaagagcaugagacaucauggcacuaugaccaagaccacccauauaaaacgugggccuaccauggcagcuacgaaacaaaacagacuggaucggcaucauccauggugaauggaguaguuagacugcugacaaaaccuugggacgucauccccauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuaggaaagaaaaaaacaccuagaaugugcacuagagaagaauucacaagaaaggugagaagcaaugcagcccuaggugccauauucacugaugagaauaaguggaagucggcacgugaggcuguugaagacaguagauuuugggaacugguugacaaggaaaggaaucuccaucuugaaggaaaaugugagacauguguguacaacaugaugggaaagagagagaagaagaugggagaauucggcaaagcaaaaggcagcagagccauaugguacauguggcuuggagcacgcuucuuagaguuugaagcccugggauucuugaaugaagaucacugguuuuccagagagaacucucugagcggaguagaaggagaagggcugcacaagcuggguuacauucuaagagaagugagcaagaaagaaggaggagcaauguacgccgacgacacagcaggaugggacacaagaaucacacuagaagacuuaaaaaaugaagaaauggugacaaaccacauggaaggagaacacaagaaacuugcugaggccauuuucaaauuaacguaccaaaacaagguggugcgugugcaaagacccacaccaagaggcacaguaauggauauuauaucgagaagagaccaaagagguaguggacaaguuggcaccuauggccucaacaccuuuaccaauaugggagcccaacugaucagacagauggagggagaaggagucuuuaaaagcauccagcaucugacaaccacagaagaaguugcagugcaagacugguuagcaagaguggggcgugagagguuaucaagaauggccaucaguggagaugauuguguugugaaacccuuagaugacagguuugcaagcgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucguaguuccauguagaaaucaagaugaacugauugguagagcucgaauuucccagggagccggguggucuuugcgggagacggccugucuggggaagucuuacgcccaaauguggagccugauguacuuccacagacgugaucucaggcuggcggcuaacgcuauuugcucggcagucccaucacauuggguuccaacaagucgaacaaccugguccauacacgccagacaugaauggaugacaacagaagacauguugacagucuggaacaggguguggauucaagaaaacccauggauggaagacaaaacuccaguggaaucaugggaggaaaucccauacuuggggaaaagagaagaccaauggugcggcucauugauaggguuaacaagcagggccaccugggcaaagaacauccaaacagcaauaaaccaagucagauccuuaauaggcagugaggaauacacagacuauaugccauccaugaaaagauucagaagagaagaggaagaggcaggggucuugugguag

SEQ ID NO: 7062 - RNA, 9876 nt, Artificial Sequence
  derived and/or modified CDS sequence (wt) from DENV-2__KJ918750__SS-prME
acugcaggcaugaucaucaugcugauuccaacagugauggcguuucauuugaccacacgcaacggagaaccacacaugauugucaguagacaagaaaaggggaaaagccuucuguuuaagacaaaggauggcacgaacaugugcacccucauggccauggaccuuggugaguugugugaagacacaaucacguauaaauguccuuuucucaggcagaacgaaccagaagacauagauuguuggugcaacuccacguccacauggguaacuuaugggacguguaccaccacaggagagcacagaagagaaaaaagaucaguggcgcuuguuccacacgugggaaugggauuggagacacgaacugaaacauggaugucaucagaaggggccuggaaacaugcccagagaauugaaauuuggauucugagacauccaggcuuuaccauaauggccgcaauccuggcauacaccauaggaacgacgcauuuccaaagaguccugauauucaucuuacugacagccaucgcucccucaaugacaaugcgcugcauaggaauaucaaauagggacuuuguggaaggagugucaggagggaguuggguugacauagucuuagaacauggaaguugugugacgacgauggcaaaaaauaaaccaacauuggacuuugaacugauaaaaacagaagccaaacaacccgccacucuaaggaaguacuguauagaggcuaaacugaccaacacgacaacagacucgcgcugcccaacacaaggggaacccacccugaacgaagagcaggacaaaagguuugucugcaaacacuccaugguagacagaggauggggaaauggauguggauuauuuggaaaaggaggcaucgugaccugugcuauguucacaugcaaaaagaucaugaaaggaaaaauugugcagccagaaaacuuggaauacacugucgugauaacaccucacucaggggaagaacaugcagucggaaaugacacaggaaaacaugguaaggaagucaagauaacaccacagagcucuaucacagaggcggaacugacaggcuauggcacuguuacgauggagugcucuccgagaacgggccucgacuucaaugagaugguguugcuccaaauggaagacaaagcuuggcuggugcacagacaaugguuccuagaccuaccgcugccauggcugcccggagcagacacacaaggaucaaauuggauacagaaagagacauuggucacuuucaaaaauccccaugcgaaaaaacaggacguuguugucuuaggaucccaagagggggccaugcauacagcacucacaggggcuacggaaauccagaugucaucaggaaacuugcuguucacaggacaucucaaaugcaggcugagaauggacaaauuacagcuuaaagggaugucauacuccaugugcacaggaaaguuuaaagucgugaaggaaauagcagaaacacaacauggaacaauagucauuagaguacaauaugaaggagacggcucuccaugcaagauccccuuugagauaauggaucuggaaaaaagacauguuuugggccgccugaucacagucaacccaauuguaacagaaaaagacaguccagucaacauagaagcagaaccuccauucggagacagcuacaucaucauaggaguggaaccaggacaauugaagcuuaacugguucaagaaaggaaguuccauuggccaaauguuagagacaacaaugaggggagcgaaaagaauggccauuuugggugacacagccugggauuuuggaucucugggaggaguguucacaucaauaggaaaggcucuccaccagguuuuuggagcaaucuauggggcugcuuucaguggggucucauggacuaugaagauccucacaggaguuaucaucacauggauaggaaugaacucacguagcacaucacugucugugucacuaguauuagugggaaucgugacacuauacuugggaguuauggugcaggccgauagugguugcguugugagcuggaagaacaaagaacuaaaauguggcaguggaauauuugucacagauaacgugcauacauggacagaacaauacaaguuccaaccagaauccccuucaaaacuggcuucagccauucagaaagcucaugaagaggguauuuguggaauccgcucaguaacaagacuggaaaaucucauguggaaacagauaacaccagaauugaaucacauucuaucagaaaaugaagugaagcugaccaucaugacaggagacaucaaaggaaucaugcagguaggaaaacgaucucugcggccucaacccacugaguugagguauucauggaaaacaugggguaaagcgaaaaugcucuccacagaacuccacaaucagaccuuucucauugauggucccgaaacagcagaaugccccaacacaaacagagcuuggaauucacuggaaguugaggacuacggcuuuggaguauucaccaccaauauauggcuaagauugagagaaaagcaggauguauuuugugacucaaaacucaugucagcggccauaaaggacaacagagccguccaugcugauauggguuauuggauagaaagcgcacucaaugacacauggaagauagagaaagcuucuuucauugaaguuaaaaguugccacuggccaaagucacacacucuauggagcgauggaguacuagaaagcgagaugguaauuccaaagaauuucgcuggaccagugucacaacauaacaacagaccaggcuaucacacacaaacagcaggaccuuggcaucuaggcaaacuugagauggacuuugauuucugcgaagggacuacaguggugguaaccgaggacuguggaaacagagggcccucuuuaagaacaaccacugccucuggaaaacucauaacggaauggugcugucgaucuugcacguuaccaccgcuaagauacagaggugaggauggaugcugguaugggauggaaaucagaccauuaaaagagaaagaagaaaaucuggucaguucucuggucacagccggacaugggcagauugauaauuucucauuaggaaucuugggaauggcauuguuccuugaagaaaugcucaggacucgaguaggaacgaaacaugcaauauuacuagucgcaguuucuuucgugacauuaaucacagggaacaugucuuuuagagaccugggaagagugaugguuauggugggugccaccaugacagaugacauagguaugggugugacuuaucucgcucuacuagcagcuuucaaagucagaccaaccuuugcagcuggacugcucuugagaaaacugaccuccaaggaauuaaugaugaccaccauaggaaucguucuucucucccaaaguagcauaccagagaccauucuugaacugacugaugcguuagcuuugggcaugaugguccucaagauggugagaaacauggaaaaauaucagcuggcagugaccaucauggccauuuuaugcgucccaaaugcugugauauuacagaacgcauggaaagugaguugcacaauauuggcauuggugucuguuuccccccuguucuuaacauccucacaacagaaagcggauuggauaccauuagcauugacgaucaaaggucucaauccaacagccauuuuucuaacaacccucucaagaaccagcaagaaaaggagcuggccuuuaaaugaggccaucauggcgguugggauggugagcaucuuggccagcucucucuuaaagaaugacauccccaugacaggaccauuaguggcuggaggucuucuaacugugugcuaugugcuaacugggcggucagccgaucuagaauuagagagagcugccgaugucaaaugggaugaccaggcagagauaucagggagcaguccaauucugucaauaacaauaucagaagauggcagcaugucaauaaagaaugaagaagaagagcaaacacugacuauacucauuagaacaggauugcuugugaucucaggacucuuuccgguaucaauaccaauuacagcagcagcaugguaccugugggaagugaagaaacaacgggcuggaguguugugggauguccccucaccaccacccgugggaaaggcugaauuggaagauggagccuacagaaucaagcaaaaaggaauucuuggauauucccagaucggagccggaguuuacaaagaaggaacauuucacacaauguggcacgucacacguggcgcuguccuaaugcauaaggggaagaggauugaaccaucaugggcggacgucaagaaagacuuaauaucauauggaggagguuggaagcuagaaggagaauggaaagaaggagaagaaguccagguccuggcauuggagccugggaaaaauccaagagccguccaaacaaagccuggccuuuuuaaaaccaacaccggaaccauaggugccguaucucuggacuuuuccccugggacgucaggaucuccaaucgucgacaaaaaaggaaaaguuguaggucucuauggcaauggugucguuacaaggaguggagcauaugugagugccauagcucagacugaaaaaagcauugaagacaauccagagauugaagaugacaucuuucgaaagagaagauugacuaucauggaucuccacccaggagcaggaaagacaaaaagauaccucccggccauagucagggaggcuauaaaaagaggcuugagaacacuaauccuagcccccacuagagucguggcagccgaaauggaggaagcccuuagaggacuuccaauaagauaccaaaccccagcuaucagggcugagcacaccgggcgggagauuguggacuuaaugugucaugccacauuuaccaugaggcugcuaucaccaaucagggugccaaauuacaaccugaucaucauggacgaagcccauuuuacagauccagcaagcauagcagcuaggggauacaucucaacucgaguggagaugggugaggcagcuggaaucuuuaugacagccacuccuccggguagcagagauccauuuccucagaguaaugcaccaauuauggacgaagaaagagaaauuccggaacguucguggaacuccggacaugagugggucacggauuuuaaaggaaagacuguuugguuuguuccaagcauaaaaaccggaaaugacauagcagccugccugagaaagaauggaaagagggugauacaacucaguaggaagaccuuugauucugaauaugucaagacuagaaccaaugacugggauuucguggucacaacugacaucucggaaaugggcgccaacuuuaaagcugagaggguuauagaccccagacgcugcaugaaaccaguuauacugacagacggcgaagagcgggugauucuggcaggacccaugccagugacccacucuagugcagcacaaagaagagggagaauaggaaggaauccaaagaaugaaaaugaucaauauauauauaugggggaacccuuggaaaaugacgaagacugugcgcacuggaaggaagcuaagaugcuccuagauaacaucaacacaccugaaggaaucauuccuagcauguucgagccagagcgugaaaagguggaugccauugacggugaauaucgcuugagaggagaagcaaggaaaacuuuuguggaccuaaugagaagaggagaccuaccagucugguuggcuuauaaaguggcagcugaagguaucaacuacgcagacagaagaugguguuuugacggaaccagaaacaaucaaaucuuggaagaaaauguggaaguggaaaucuggacaaaggaaggggaaaggaaaaaauugaaaccuagaugguuggaugcuaggaucuacuccgacccacuggcgcuaaaagaauucaaggaauucgcagccggaagaaagucccuaacccugaaccuaaucacagagaugggcagacucccaacuuuuaugacucagaaggccagagaugcacuagacaacuuagcggugcugcauacggcugaagcagguggaaaggcauacaaucaugcucucagugaacuaccggagacccuggagacauugcuuuugcugacacuguuggccacagucacgggaggaaucuuucuauuccugaugagcggaagggguauagggaagaugacccugggaaugugcugcauaaucacggccagcauccucuuauggugugcacaaauacaaccacauuggauagcagcuucaauaauauuggaguucuuucucauagucuugcucauuccagaaccagaaaagcaaaggacaccccaggauaaccaauugaccuaugucaucauagccauccucacagugguagccgcaaccauggcaaacgaaauggguuuccuggaaaaaacaaagaaagaccucggacugggaaacauaguaacucagcaaccugagagcaacauucuggacauagaucuacguccugcaucagcauggacguuguaugccguggcuacaacauuuaucacaccaauguugagacauagcauugaaaauuccucaguaaacaugucccuaacagccauugcuaaccaagccacaguacuaaugggucucgggaaaggauggccauugucaaagauggacauuggaguuccccuccuugcuauuggguguugcucacaagucaacccuauaacccucacagcggcucuuuuuuuauugguagcacauuaugccaucauaggaccgggacuucaagccaaagcaaccagagaagcucagaaaagagcagcagcgggcaucaugaaaaacccaacuguggauggaauaacagugauagaucuagauccaauacccuaugauccaaaguuugaaaaacaguugggacaaguaaugcucuuaguccucugugugacccaagugcugaucaugaggacuacgugggcuuugugugaagccuuaacucuagcaaccggacccguauccacauugugggaaggaaauccagggagauucuggaacacaaccauugcagugucaauggcaaacaucuuuagagggaguuaccuggcuggugcuggacuucucuuuuguaucaugaauaacacaaccagguugagaagaggaacuggccacuuaagaaaaacgcuaggcgacaaaugcaaaagcagacugaacaccuuggggaaaagugaauuccagaucuacaagaaaaguggaauucaagaaguggacagaaccuuagcaaaagaaggcauuaaaagaggagaaacggaucaucacgcugugucgcgaggcucagcaaaacugagaugguucguugaaagaaaucuggucacaccagaagggaaaguaguggaccuugguuguggcagagggggcuggucauacuauuguggaggacuaaagaauguaagagaaguuaaaggcuugacaaagggaggaccaggacacgaagaaccuauccccaugucaacauauggguggaaucuaguacgcuuacagagcggaguugacguuuucuucauuccaccagagaagugugacacauuguugugugacauaggggaaucaucaccaaaucccacgguagaagcgggacgaacacucagaguccuuaaccuaguagaaaauuggcugaacaauaacacccaauuuugcauaaagguccuuaacccguacaugcccucagucauugaaaaaauggaaaccuuacaacggaaauacggaggagccuuggugagaaauccacucucacggaauuccacacaugagauguacuggguguccaaugcuuccgggaacauagugucaucagugaacaugauuucaagaaugcugauuaacagauucaccaugagacacaagaaggccacuuaugaaccagaugucgaccucggaagcggaacccgcaauauuggaauugaaagugagacaccgaaccuagacauaauuggaaaaagaauagaaaaaauaaaacaagagcacgaaacgucauggcacuaugaccaagaccacccauacaaaacaugggcuuaccauggcagcuaugaaacaaaacagacuggaucagcaucauccauggugaacggaguagucagacugcugacaaaacccugggacguuguuccaauggugacacagauggcaaugacagacacaacuccuuucggacaacagcgcgucuucaaggagaagguggauacgagaacccaagaaccaaaagaaggcacaaaaaaauuaaugaaaaucacggcagaauggcucuggaaagaacuaggaaagaaaaagacaccuagaaugugcaccagagaagaauucacaaaaaaggugagaaguaaugcagccuugggggccauauucaccgaugagaacaaguggaaaucggcgcgugaggcuguugaagauggcagguuuugggagcugguugacaaggaaaggaaucuccaucuugaagggaaaugugaaacauguguguacaacaugaugggaaaaagagagaaaaaacuaggagaguuuggcaaagcaaaaggcagcagagccauaugguacauguggcuuggagcacgcuucuuagaguuugaagcccuaggauuuuugaaugaagaccauugguucuccagagagaacucccugaguggaguggaaggagaagggcugcacaagcuagguuacaucuuaagagaggugagcaagaaagagggaggagcaauguaugccgaugacaccgcaggcugggacacaagaaucacaauagaggauuuaaaaaaugaagaaaugauaacgaaccacauggcaggagaacacaagaaacuugccgaggccauuuuuaaauugacguaccaaaacaagguggugcgugugcaaagaccaaccccaagaggcacaguaauggacaucauaucgagaagagaccaaagggguaguggacaaguugguaccuauggccucaauacuuucaccaacauggaagcacaacuaauuaggcaaauggagggggaaggaaucuucaaaagcauccagcacuugacagccacagaagaaaucgcugugcaagauuggcuagcaagaguagggcgugaaagguuaucaagaauggccaucaguggagaugauuguguugugaaaccucuagaugauagauuugcaagagcccuaacagcucuuaaugacaugggaaagguuaggaaggacauacaacaaugggagcccucaagaggauggaacgacuggacacaggugcccuucuguucacaccauuuucacgaguuaauuaugaaagauggucgcacacucguaguuccauguagaaaccaagaugaauugauugguagagcccgaauuucccagggagcuggguggucuuuacgggagacggccugucuggggaagucuuacgcccaaauguggagcuugauguacuuucacagacgugaucucaggcuagcggcaaaugccaucugcucggcagucccgucacacuggguuccaacaagccggacaaccugguccauacacgccagccaugaauggaugacgacggaagacauguugacaguuuggaacagaguguggauccaagaaaauccauggauggaagacaaaacuccaguggaaucaugggaggaaaucccauaccugggaaaaagagaagaccaauggugcggcucacugauugggcugacaagcagagccaccugggcgaagaauauccagacagcaauaaaucaagucagaucccucauuggcaaugaggaauacacagauuacaugccauccaugaaaagauucagaagagaagaggaagaggcaggaguuuugugguag

SEQ ID NO: 7063 - RNA, 9876 nt, Artificial Sequence
  derived and/or modified CDS sequence (wt) from DENV-2__KU517845__SS-prME
acugcagguauaauuauuaugaugaucccaacagugauagcguuccauuuaaccacacgcaacggagaaccacacaugaucgucaguagacaagagaaagggaaaagccuucuguuuaaaacagagaacggugugaacauguguacccucauggccauggaccuuggugaacugugugaagacacaaucacuuauaacuguccucuucucaggcagaaugaaccagaagacauagacuguuggugcaacucuacgucugcauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcauacaccauaggaacaacauauuuccaaagaguccugauuuucauuuuacugacagcugucacucccucaaugacaaugcguuguauaggaauaucaaauagagacuuuguggaagggguuucaggagggagcuggguugacauagucuuggaacauggaagcugugugacgacgauggcgaaaaacaaaccaacauuggauuuugaacugauaaaaacagaagccaaacauccugcuacucuaaggaaguauuguauagaggcaaagcugaccaauacaacaacagcaucucgcugcccaacacaaggagaaccuagccuaaaugaagaacaggacaaaagauucgucugcaaacacuccaugguagauagaggauggggaaauggaugcggauuauuuggaaagggagguaucgugaccugugcaauguucacauguaaaaagaacauggaaggaaaaaucgugcaaccagaaaauuuggaguacaccaucgugauaacaccucacucaggggaagagaaugcagucggaaaugacacaggaaaacacggcaaggaaauuaaagugacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaagagacauuggucacuuucaaaaauccccaugcaaagaaacaggauguuguuguuuuaggaucccaagaaggggcuaugcacacagcacucacaggggccacggagauccagaugucaucaggaaacuuacuguucacaggacaucuuaaaugcagguugagaauggacaaacuacagcucaaaggaaugucauauuccauguguacaggaaaguucaaaguugugaaggaaauagcagaaacacaacauggaacaauaguuaucagaguacaauaugaaggggacgguucuccgugcaaaaucccuuuugaaauaauggauuuggaaaaaagacaugucuuaggucgcuugaucacagucaacccgauugucacagaaaaagacagcccagucaauauagaagcagaaccuccauucggagauagcuacaucauuauaggaguagaaccgggacaacugaagcucagcugguucaagaaaggaaguucuauuggccaaauguuugagacaacaaugcgaggagcaaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgacagugguuguguugugaguuggaaaaacaaagaacugaaauguggcagugggauuuuuaucacagacaacgugcacacauggacagaacaauacaaauuccaaccagaaucccccucaaagcuggcuucagcuauccagaaggcucaugaagaaggcauuuguggaauccgcucaguaacaagacuggagaaucugauguggaaacaaauaacaccagaauugaaucacauucuaucagaaaaugagguaaaguugacuaucauggcaggagacauuaaaggaaucaugcaagcaggaaaacgaucccugcggccucaacccacugagcugaaguauucuuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccaccaacauaugguugaaauugaaggaaaggcaggaugcauuuugugacucaaaacucaugucagcagccauaaaagacaacagagccauccacgccgauauggguuauuggauagaaagcgcacucaaugacacauggaagauugagaaagccuccuuuauugaaguuaaaagcugccacuggccaaagucacacacucucuggaguaauggagugcuggaaagugagaugauaauuccaaagaauuuugcaggaccagugucacaacacaauuacagaccaggcuaucauacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguauggaauggaaaucagaccauugaaagagaaagaggagaacuuggucaauucuuuggucacagccgggcauggacagauugacaacuucucacuaggagucuugggaauggcauuguuccuggaagagaugcucaggacccgaguaggaacgaaacaugcaauauuacuaguugcaguuucuuuugugacauugaucacagggaacaugucuuuucgagauuugggaagagugauggucauggugggcgcuaccaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucacagaguaccauaccagagacuauacuugaacugacugaugcauuggcucuggggaugaugguucucaaaauagugagaaauauggaaaaguaucaacuagcagugacuaucauggccaucuugugcgucccaaaugcagugauauuacaaaacgcauggaaagugagcugcacaacauuggcagugguguccguuuccccacugcuuuuaacauccucacagcagaaagcagauuggauaccacugguguugacgaucaaaggccucaauccaacagccauuuucuuaacaacccucucaagaacuagcaagaaaaggagcuggccacuaaaugaggcuauuauggcagucgggauggugagcauucuagccaguucucuccuaaagaaugauauucccaugacaggaccauuaguggcuggagggcuucucacuguguguuacgugcucacuggaagaucggcugauuuggaacuggaaagagcugcugacguaagaugggaagaacaggcagaaauuucaggaaguaguccaauucugucgauaacaguaucggaagaugguagcaugucgauaaaaaaugaagaagaagaacaaacauugaccauacucaucagaacaggacugcuggugauaucaggacuuuuuccugugucaauaccaaucacggcagcugcaugguaccugugggaagugaaaaaacaacgagcaggaguauugugggaugucccuucacccccaccugugggaaaggccgaacuggaagauggagccuauagaaucaagcagaaagggauccuaggauacucgcagauuggagccggaguuuacaaagaaggaacauuccacacaauguggcaugucacacguggugcuguccuaaugcauaaagggaagagaauugaaccaucaugggcggacgucaaaaaagaccuaauaucguauggaggaggcuggaagcuagaaggagaauggaaggaaggagaagaaguccagguccuggcauuagagccuggaaagaacccaagagccguccaaacaaaacccggucuuuuuaaaaccaacacuggaaccauaggcgccgugucucuggauuucucuccuggaacgucaggaucuccaaucgucgacaaaaaaggaaaaguugugggccuuuauggcaacgguguugucacaaggaguggaacauaugugagugccauagcccagacugaaaaaagcaucgaagacaauccagagauugaagaugacaucuuucgaaagaaaagauugaccaucauggaccuccacccaggagcagggaaaacaaagagauaccuuccagcaauagucagagaagccauaaaacgaggcuugagaacacuaauccuggcacccacuagaguuguggcggcugaaauggaagaagcucucagaggacuuccaauaagauaccaaaccccagcuauuagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugguauuuucaugacagcuaccccuccuggaagcagagacccauuuccucagagcaaugcaccaaucauggacgaagaaagagaaaucccugagcguucguggaacucuggacaugaguggguuacggauuuuaaagggaagacuguuugguuuguuccaaguauaaaagcagggaaugacauagcagcuugccugagaaagaauggaaagaaagugauacaacucagcaggaagacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaagaugcuuuuggacaacaucaacacgccugaaggaaucauuccuagcauguucgaaccagagcgugaaaagguggaugccauugauggugaauaccgcuugagaggagaagcgaggaaaacuuuuguggaccuaaugagaagaggagaucuaccagucuggcuagccuacagaguggcagcugaagguaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccacuggcgcucaaagaauucaaggaauucgcagcuggaagaaagucccugacccugaaucucaucacagagauggguagacucccaaccuucaugacccagaaagcaaggaaugcauuagacaacuuagcaguccugcauacggcugaagcaggcggaagggcguacaaucaugcucuuagugaacugccggagacucuggaaacauugcuuuuacugacacuuuuggccacagucacgggcggaaucuuccuguucuugaugagcggaaaagguauagggaagaugacccugggaaugugcugcauaaucacggcuaguauucuccuaugguaugcacaaauacagccacacuggauagcagcuucaauaauacuggaguuuuuucucauagucuugcucauuccagaaccagaaaagcagagaacaccccaagauaaccaguuaacuuauguugucauagccauccuuacagugguggccgcaaccauggcaaacgagauggguuuccuggaaaaaacaaagaaagauuucggauugggaagcauugcaaaccagcaaccugagaguaauauccuggacauagaucuacguccugcaucagcuuggacucuauaugccguggcaacaacuuucaucacaccaauguugaggcauagcauagaaaauuccucagugaaugugucuuuaacagccauugccaaccaagcuacaguguuaaugggucuugggaaaggauggccauuaucaaaaauggacaucggaguuccccuucucgcuaucgggugcuauucacaagucaaccccauaacucucacagcagcccuucucuuauugguagcacacuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcuguuaguccucugcgugacucaaguguugaugaugaggacuacaugggcuuuaugugaagcucuaaccuuagcaaccgggcccaucucuacacugugggaaggaaacccagggagauuuuggaauacaacuauugcaguaucaauggcuaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaaggcauuaaaagaggagaaacggaccaucacgcugugucgcgaggcucagcgaaacugagaugguucgucgagagaaacuuggucacaccagaagggaaaguaguggaccuuggcugcggcagggggggcuggucauacuauugugggggacuaaagaauguaaaagaaguuaaaggcuuaacaaaaggaggaccaggacacgaagaacccauucccaugucaacauaugguuggaaucuggugcgucuucaaaguggaguugauguuuuuuuuacuccgccagaaaagugugacacauugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcguuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgaaccagauguugaccucggaaguggaacccgcaacaucgggauugaaagugagacaccaaauuuagacauaauugggaaaagaauagaaaaaauaaaacaagagcaugaaacaucauggcacuaugaccaagaccacccauacaaaacgugggccuaccauggcagcuacgaaacgaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaggaaggcacgaaaaaaauaaugaaaaucacggcagaauggcuuuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaccuccaucuugaaggaaagugugagacauguguguacaacaugaugggaaagagagagaagaagcuaggggaguucggcaaagcaaaaggcagcagggccauaugguacauguggcuuggagcacgguucuuagaguuugaagcucuaggauucuugaaugaagaucacugguuuuccagagagaacucccugagcggaguggaaggagaagggcugcacaaauuaggcuacauuuuaagagacgugaguaagaaagaaggaggagcaauguaugccgaugacaccgcaggaugggacacaagaaucacacuagaggacuuaaagaaugaagaaauggugacaagccacaugaaaggagaacacaggaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaacugacagucacagaagaaauugcagugaaaaacugguuaguaagaguggggcgugagagguugucaagaauggccaucaguggagaugauuguguugugaaacccuuagaugacagguuugcaagugcucuaacagcucuaaaugacaugggaaagguuaggaaagacauacaacaaugggaaccuucaagaggauggaacgacuggacacaagugcccuuuuguucacaccauuuccaugaguuaaucaugaaggacggucguguacucguaguuccaugcagaaaccaagaugaacugauugguagggcucgaauuucccagggagccgggugguccuugcgagaaacagccuguuuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacaguuuggaacaggguguggauucaagaaaacccauggauggaagacaaaacuccaguagaaucaugggaggaaaucccguauuugggaaaaagagaagaccaauggugcggcucauugauugggcuaacaagcagggcuaccugggcaaagaacauccaaacagcaauaaaucaaguuagaucccuaauaggcaaugaggaauacacagacuacaugccauccaugaaaagauucagaagagaagaggaagaggcaggagucuugugguag

SEQ ID NO: 7064 - RNA, 9876 nt, Artificial Sequence
  derived and/or modified CDS sequence (wt) from DENV-2__KU517847__SS-prME
acugcagguauaauuauuaugaugaucccaacagugauggcguuccauuuaaccacacgcaauggagaaccacacaugaucgucaguagacaagagaaagggaaaagucuucuguuuaaaacagagaacggugugaacaugugcacccucauggccauggaucuuggugaacugugugaagacacaaucacuuacaauuguccucuucucaggcagaaugaaccagaagacauagacuguuggugcaacucuacgucuacauggguaacuuaugggacaugcaccgcuacaggagaacacagaagggaaaaaagaucaguggcacucguuccacaugugggaaugggacuggagacacgaacugaaacauggaugucaucagaaggggccuggaaacaugcacagagaauugaaacuugggucuugagacauccaggcuucaccauaauggcagcaauccuggcauacaccauaggaacgacauauuuccaaagaguccugauuuucaucuuacugacagcuguugcucccucaaugacaaugcguuguauaggaauaucaaauagagacuuuguggaagggguuucaggaggaagcuggguugacauaguccuggaacauggaagcugugugacgacgauggcaaaaaauaaaccaacauuggauuuugaacugauaaagacagaagcgaaacaucccgccacucuaaggaaguauugcauagaggcaaagcugaccaacacaacaacagcaucucgcugcccaacacaaggagaaccuagccuaaaugaagaacaggacaaaagauuugucugcaaacacuccaugguagauagaggauggggaaauggaugcggauuauuuggaaagggagguaucgugaccugugcaauguucacaugcaaaaagaacauggaagggaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggacucgacuucaaugagaugguguugcugcaaauggaaaacaaggcuuggcuggugcacaggcaaugguucuuagaccugccauuaccauggcugcccggagcagacacacaaggaucaaauuggauacagaaggagacauuggucacuuucaaaaauccccaugcaaagaaacaggauguuguuguucuaggaucccaagaaggggcuaugcacacagcacuuacaggggccacggaaauccagaugucaucaggaaacuuacuguucacaggacaucuuaaauguaggcugagaauggacaaacuacagcucaaaggaaugucauauuccaugugcacaggaaaguucaaaguugugaaggaaauagcagaaacacaacauggaacaauaguuaucagaguacaauaugaaggggacgguucuccgugcaagaucccuuuugaaauaauggauuuggaaaaaagacaugucuuaggucgcuugaucacagucaacccaauugucacagaaaaagacagcccagucaacauagaagcagaaccuccauucggagacagcuacaucauuauaggaguagaaccgggacaacugaagcucagcugguuuaagaaaggaagcucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacguagcacuucacugucugugucacuaguauuagugggagucgugacauuguauuugggaguuauggugcaggccgauagugguugcguugugagcuggaaaaacaaagaacugaaauguggcagugggauuuuuaucacagacaacgugcauacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaacugaaucacauucuaacagaaaaugagguaaaguugacuaucaugacaggagacauuaaaggaaucaugcaggcaggaaaacgaucccugcggccucaacccacugagcugaaguacucuuggaaagcauggggcaaagcgaaagugcucuccacagagcuucauaaccacaccuuucucauugauggccccgaaacagcagaaugucccaacacaaauagagcuuggaacucacuagagguugaggacuauggcuuuggaguauucaccacuaacauauggcugaaauugaaagaaaggcaggauguaucuugugacucaaaacucaugucggcagccauaaaagacaacagagccguccacgccgacauggguuauuggauagaaagcgcacucaaugacacauggaagauugagaaagccuccuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaacuacagugguggugacugaaaacuguggaaauagaggacccuccuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcuuagaacccgaguagggacgaaacaugcaauauuacuaguugcagucucuuucgugacauugaucacagggaacauguccuuucgagauuuggggagagugauggucauggugggcgcuacuaugacggaugacauaggcaugggcgugaccuaucuugcccuauuagcagccuucaaggucagaccaacuuuugcagcuggacuacucuuaagaaagcugaccuccaaggaauugaugaugaccaccauaggaaucguacuccucucucagagcaccauaccagagaccauacuugaacugacugacgcguuggcuuuggggaugaugguucucaaaauaguaagaaacauggaaaaguaucaacuagcagugacuaucauggcuaucuugugcgucccaaaugcagugauauuacaaaacgcauggaaagugagcugcacagcacuggcagugguguccguuuccccacugcuuuuaacaucuucacagcagaaaacggauuggauaccacuggcguugacgaucaaaggccuuaauccaacagccauuuucuuaacaacccucucaagaacuaguaagaaaaggagcuggccacuaaaugaggcuauuauggcagucgggauggugagcauuuuagccaguucuuucuuaaagaaugacauucccaugacaggaccacuaguggcuggagggcuucucacuguguguuacgugcucacuggaagaucggcugauuuggaacuggagagagcugcugacauaagaugggaagaacaggcagagauaucaggaagcaguccaauuuugucgauaacaauaucggaagauggcagcaugucgauaaaaaaugaagaagaagaacaaacacugaccauacugauuagaacaggacugcuggugauaucaggacuuuuucccgcgucaauaccaaucacggcagcugcaugguaccugugggaagugaaaaaacaacgagccggaguauugugggaugucccuucaccuccaccugugggaagggccgaacuggaagacggagccuauagaaucaagcagaaagggauuuugggauacucgcagauaggagccggagucuacaaagaaggaacuuuccacacaauguggcaugucacacguggugcuguucuaaugcauaaagggaagagaauugaaccaucaugggcggacgucaagaaggaccuaauaucguauggaggagguuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuuccccuggaacgucaggaucuccaauugucgacaaaaaaggaaaaguugugggccuuuauggcaacggugucgucacaaggaguggaacauacgugagugccauagcccagacugaaaaaagcauugaagacaacccagagauugaagaugacaucuuucgaaagaaaagacugaccaucauggaccuccacccaggagcaggaaaaacaaagagauaccuuccagcaauagucagagaagccauaaaacgaggcuugagaacacuaauccuggcccccacuagagucguggcggcugaaauggaagaagcucucagaggacuuccaauaagauaucaaaccccagcuaucagagcugagcacacuggacgggagauuguggaucuaaugugucacgccacauuuaccaugaggcuacuaucaccaauuagagugccaaauuacaaccugauuaucauggaugaagcccauuucacagacccagcaagcauagcggcuagaggauacaucucaacucgaguagagaugggugaagcagcugggauuuuuaugacagccaccccuccuggaagcagagacccauuuccucagagcaacgcaccaaucauggaugaagaaagggaaauuccugagcguucguggaacucuggacaugaguggguuacggauuuuaaagggaagacuguuugguuuguuccaaguauaaaagcaggaaaugauauagcagcuugccugagaaagaaugggaagaaagugauacaacucagcaggaagaccuuugauucugaauauaucaagacuaggaccaaugauugggacuuuguggucacgacagacauuucagaaaugggugcuaacuucaaggcugagaggguuauagaccccagacgcugcaugaaaccagucauacuaacagacggugaagaacggguuauccuggcaggacccaugccagugacccacucuagugcagcacaaagaagagggagaguaggaagaaauccaaaaaaugaaaaugaccaguauauauacaugggggaaccucuggaaaaugaugaagacugcgcacacuggaaagaagcuaagaugcuucuagauaacaucaacacgccugaaggaaucauucccagcauguuugaaccagagcgugagaaggucgacgccauugauggugaauaccgcuugagaggagaagcgaggaaaacauuuguggaccuaaugagaagaggagaccuaccaguuuggcuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauuaaaacccagaugguuagaugcuaggaucuacucugacccacuggcacuuaaagaauucaaggaauucgcagcuggaagaaaaucccugacccugaaucuaaucaccgagauggguaggcucccaaccuucaugacccagaaagcaaggaaugcauuggacaacuuagcaguccuacacacggcugaagcaggcggaagggcguacaaucaugcucuuagugaacugccggagacucuggagacauugcuuuuacugacacuuuuggccacagucacaggcggaaucuuccuguucuugaugagcggaaaggguauagggaagaugacccugggaaugugcugcauagucacagccaguauucuucuaugguaugcacaaauacagccacauuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaaugagauggguuuccuggaaaaaacaaagaaagauuucggauugggaagcaucacaacccagcaaccugagagcaacauccuggacauagaucuacguccugcaucagcuuggacucuauaugcuguggcaacaacuuucaucacaccaauguugagacauagcauugaaaauuccucagugaaugugucucuaacagccauugccaaccaagccacaguguuaaugggucuugggaaaggauggccauugucgaaaauggacaucggaguuccccuucucgcuaucggaugcuauucacaagucaaccccauaacccucacagcagcccuucucuuauugguagcacauuaugcuaucauagggccaggacuccaagcgaaagcaaccagagaggcucagaaaagagcagcagcgggcaucaugaaaaacccaacuguggauggaauaacagugauugaccuagauccaauaccauaugauccaaaguuugaaaagcaguugggacaaguaaugcucuuaguccucugcgugacucaaguauugaugaugaggacuacaugggcuuuaugugaagcucuaacuuuagcgaccgggcccaucucuacacugugggaaggaaauccagggagauuuuggaauacaacuauugcagugucaauggcuaacauuuuuagagggaguuaccuggccggagccggacuucucuuuucuaucaugaagaacacggccaacacaagaaggggaacuggcaacacaggagaaacgcuuggagagaaauggaaaaaccgguugaaugcauuggggaagagugaauuccagaucuauaagaaaaguggaauccaggaaguggauagaacguuagcaaaagaaggcaucaagagaggagaaacggaccaucacgcugugucgcgaggcucagcgaaacugagaugguucgucgagagaaaccuugucacaccagaagggaaaguaguggaccuuggcugcggcagggggggcuggucauacuauugugggggacuaaaaaauguaaaggaagucaaaggccuaacaaaaggaggaccaggacacgaagaacccauucccaugucaacauaugguuggaaucuggugcgucugcaaaguggagucgaugucuuuuuuacuccgccagaaaagugugacacauugcugugugacauaggggagucgucaccaaaccccacggucgaggcaggacgaacacucagaguucuaaacuuaguggaaaacuggcugaacaauaauacccaauuuugcauaaagguucuuaauccauauaugcccucaguuauagaaaaaauggaagcacuacaaaggagauacggaggagcuuuggugaggaauccacccucacgaaauuccacacacgagauguacuggguauccaaugcuuccgggaacauagugucaucagugaacaugauuucaagaauguugauuaacagauucacaaugagacacaagaaggccacauacgagccggauguugaucucggaaguggaacccgcaacaucggaauugaaagugaaguaccaaaucuagacauaauugggaaaagaauagaaaaaauaaaacaagagcaugaaacaucauggcacuaugaucaagaccacccauacaaaacgugggccuaccauggcagcuacgaaacaaaacagacuggaucagcaucauccauggugaacggagugguuaggcugcuaacaaaaccuugggacgucauccccauggugacacagauggcaaugacagacacgacuccauuuggacaacagcgcguuuucaaagagaaaguggacacgagaacccaagaaccaaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaagcuguugaagacaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuggaguuugaagcccugggauucuugaaugaagaucacugguuuuccagagagaacucccugaguggaguagaaggagaagggcugcacaaacuaggcuacauucuaagagacgugaguaagaaagaaggaggagcaauguacgccgaugacaccgcaggaugggacacaagaaucacgcuagaggacuugaaaaaugaagaaauggugacaaaccacauggaaggagaacacaagaaacuugcugaagccauuuucagauuaacguaccaaaacaaaguggugcgugugcaaagaccgacaccaagaggcacaguaauggacauuauaucgagaagagaccaaagagguaguggacaaguugucaccuacggccucaacacuuucaccaacauggaagcccaacugaucagacagauggagggagaaggagucuucaaaagcauccagcaccugacagccacagaagaaauugcagugaaaaacugguuaguaagaguggggcgugagagguuaucaagaauggccaucagcggagaugauuguguugugaaacccuucgaugacagguuugcaaacgcucuaacagcuuuaaaugacaugggaaaggucaggaaagacauacaacaaugggaaccuucaagaggauggaacgauuggacacaagugcccuuuuguucacaccauuuccaugaguuaaucaugaaggacggucguguacuugugguuccauguagaaaccaagaugaacugauugguagggcccgaauuucccagggagccgggugguccuugcgggaaacagcuuguuuggggaagucuuacgcccaaauguggagccuaauguacuuccacagacgugaccuuaggcuggcggcaaacgcuauuugcucggcagucccuucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaagagagaagaccaguggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggaguuuugugguag

SEQ ID NO: 7065 - RNA, 9876 nt, Artificial Sequence
  derived and/or modified CDS sequence (wt) from DENV-2__JQ955623__SS-prME
acugcaggcaugauuaucaugcugauuccaacagcgauggcguuccauuuaacuacacgcaacggagaaccacacaugaucgucagcagacaagagaaagggaaaagucucuuguuuaaaacagaggauggugugaacauguguacccucauggccauggaccuuggugaacugugugaagacacgaucacuuauaacugcccucuucucaggcagaaugaaccagaagacauagauuguugguguaacuccacguccacauggguaacuuaugggacaugcacugccacaggagaacacagaagggaaaaaagaucaguggcacucgucccacauguggguaugggauuggagacacgaacugaaacauggaugucaucagaaggggccuggaaacacgcccagagaauugaaacuuggaucuugagacauccagguuuuaccauaauggcagcaaucuuggcauacaccauaggaacgacacauuuccaaagaguccugaucuucaucuuacugacagcugucgcuccuucaaugacaaugcguuguauuggaauaucaaauagagacuuuguggaagggguuucaggaggaagcuggguugauauaguccuagaacauggaagcugugugacaacgauggcaaaaaacaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguucgucugcaaacauuccaugguagacagaggauggggaaauggauguggauuauuuggaaagggaggcaucgugaccugugcuauguucacaugcaagaaaaacauggaaggaaaaaucgugcaaccagaaaaccuggaauacaccauugugguaacaccucacucaggggaagagaaugcaguuggaaaugacacaggaaaacauggcaaggaaaucaaaguaacaccacagaguuccauuacagaagcagaacugacaggcuauggcacugucacgauggagugcucuccaagaacgggccuugacuucaaugagaugguguugcugcaaauggaaaacaaagcuuggcuggugcacaggcaaugguucuuagaccugccguuaccaugguugcccggagcggacacacaaggaucaaauuggauacagaaggagacauuggucaccuucaaaaauccccaugcgaagaaacaggauguuguuguuuuaggaucccaagaaggggcuaugcauacagcacuuacaggggccacagaaauccagaugucaucaggaaaccuacuguucacaggacaucucaagugcaggcugagaauggauaaacuacagcucaaaggaaugucauacucuauguguacaggaaaguuuaaaguugugaaagaaauagcagaaacacaacauggaacaauaguuaucagaguacaauaugaaggggauggcucuccauguaaaaucccuuuugagauaauggacuuggaaaaaagacaugucuuaggucgccugauuacagucaacccaaucguuacagaaaaagacaguccagucaacauagaagcagaaccuccauucggagacagcuacaucauuguaggaguagaaccaggacaacugaagcucagcugguuuaagaaaggaaguucaaucggccaaauguucgagacaacaaugagaggagcuaagagaauggccauuuuaggugacacagccugggauuuuggaucccugggaggaguguucacaucuauaggaaaggcccuccaccaaguuuuuggagcaaucuauggggcugccuucaguggggucucauggacuaugaaaauccucauaggagucgucaucacauggauaggaaugaauucacgcagcaccucacugucugugucacuaguauuagugggaaucgugacauuguauuugggagucauggugcaggcugauagugguuguguugugaguuggaagaacaaagaacugaaauguggcagugggauuuuuaucacagacaauguacacacguggacagaacaauacaaguuucaaccagaaucccccucaaagcuggcuucagcuauccagaaagcucaugaagagggcauuuguggaauccgcucaguaacaagacuggagaauuuaauguggaaacaaauaacaccagaacugaaucacauucuaucagaaaaugagguaaaguugacuaucaugacaggagacaucaaaggaaucaugcaggcaggaaaacgaucccugcggccccagcccacugagcugaaguauucauggaaaacguggggcaaagcgaaaaugcucuccacagagccucauaaccagacuuuucucauugauggccccgaaacagcagaaugucccaacacaaacagagcuuggaacucacuagaaguugaagacuauggcuuugggguauucaccaccaauauauggcugaaguugaaagaaaggcaggauguguuuugugacucaaaacucaugucagcggccauaaaagacaacagagccguccaugccgacauggguuauuggauagaaagcgcacuuaaugacacauggaagauagaaaaagcuucuuuuaucgaaguuaaaaguugccacuggccaaaaucacacacucucuggaguaauggagugcuggaaagugaaaugauaauuccaaagaacuuugcuggaccaguaucacaacacaauuacagaccaggcuaucacacacaaacggcaggacccuggcaucuaggcaagcuugagauggacuuugauuuuugcgaaggaaccacaguaguggugacugaggauuguggaaauagaggacccucucuaagaacaaccaccgccuccggaaaacucauaacagaaugguguugccgauccugcacauuaccaccacuaagauacagaggugaggaugggugcugguacggaauggaaaucagaccauugaaagagaaagaagagaacuugguuaauucuuuggucacagccggacauggacagauugacaacuucucacuaggagucuugggaauggcacuguuccuggaagaaaugcucaggacccgaguaggaacaaaacaugcaguauuacuaguugcaguuucuuucaugacauugaucacagggaacaugucuuuucgagaccuagggagagugaugguuauggugggggcugcuaugacggaugacauaggcaugggcgugacuuaucuugccuuauuagcagccuucaaaguuagaccaacuuuugcagcuggacuacuuuugagaaagcugaccuccaaggaauugaugaugaccaccauaggaaucguacuccucucccagagcaccauaccagagacuauacuugaacugacugaugcguuagccuugggcaugaugauucucaagauagugagaaauauggaaaaguaucaauuagcagugacuaucauggcuaucuuauguguuccaaaugcagugauauuacaaaaugcauggaaagugagcugcacaauacuggcaguggugucuguuuccccacugcucuuaacaucuucacagcagaaagcggauuggauaccauuggcauugacgaucaaaggucucaacccaacagccauuuuccuaacaacccuuucaagaacuaacaagaaaaggaguuggccacuaaaugaggcuaucauggcagucgggauggugagcauuuuagccaguucucucuugaagaaugacauucccaugacaggaccauuaguggcuggagggcuucucacuguguguuacgugcucacuggaagaucggcugacuuggaacuggagagagccgccgacguaagaugggaagaucaggcagagauaucaggaagcaguccaauucugucaauaacaauaucggaagauggcagcaugucgauaaaaaaugaagaggaagaacaaacacugaccauacucauuaggacaggauugcuggugauaucaggacuuuuucccguaucaauaccaaucacggcagcagcaugguaccugugggaagugaagaaacaacgggcuggaguauugugggaugucccuucacccccaccugugggaaaggccgaacuggaagauggagcuuauagaaucaagcagaaagggauucuuggauacucccagaucggagcuggaguuuacaaagaaggaacauuccacacaauguggcaugucacacguggugcuguucuaaugcauaaagggaagaggauugaaccaucaugggcagaugucaggaaagaccuaauaucguauggaggaggcuggaagcuagaaggagaauggaaggaaggagaagaaguccaggucuuggcauuagagccugggaagaauccaagagccguccaaacaaaacccggucuuuuuaaaacuaacaccggaaccauaggcgcuguaucuuuagacuuuucuccuggaacgucaggaucuccaaucgucgacaaaaaaggaaaagucgugggucucuauggcaauggugucgucacaaggaguggaacauaugugagugccauagcccagacugaaaaaagcauugaagacaauccagagauugaagaugacaucuuucgaaaaaaaagauugaccauuauggaccuccacccaggagcgggaaaaacgaaaagauaccuuccagcaauagucagagaggccauaaaacgaggcuuaagaacauuaauccuggcccccacuagagucguagcagcugaaauggaggaagcucuuagaggacuuccgauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacggacccagcaagcauagcagcuagaggauacauuucaacucgaguagagaugggugaagcagcugggauuuucaugacagccacuccuccgggaagcagagacccauuuccccagagcaaugcaccaaucauggaugaagaaagggaaaucccugaacguucguggaauucuggacaugaguggguuacagauuuuaaagggaagacuguuugguuuguuccgaguauaaaagcaggaaaugacauagcagcuugccugagaaaaaauggaaagaaagugauacaacucaguagaaagaccuuugauucugaauacaucaagacuaggaccaaugacugggacuuuguggucacgacugacaucucagaaaugggugcuaacuucaaggcugaaaggguuauagaccccaggcgcugcaugaaaccagucauacuaacagacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauccccagcauguucgaaccagagcgugaaaagguggaugccauugauggugaguaccgcuuaagaggagaagcgaggaaaaccuuuguggaccuaaugagaagaggagaccuaccagucuggcuggccuacagaguggcagccgaaggcauuaacuaugcagacagaagguggugcuuugauggaaucaagaacaaccaaaucuuggaagaaaauguggaaguggaaaucuggacaaaagaaggggaaaggaagaaauugaaacccagaugguuggaugcuaggaucuacucugacccacuggcgcucaaagaauucaaagaguuugcagcuggaagaaaaucccugacccugaauuuaaucacagaaauggguaggcuuccaacuuuuaugacucagaaagcaaggaacgcacuggacaacuuggcaguccugcauacggcugaagcaggcggaagggcguacaaucaugcucucagugaauugccagagacccuggagacauugcuuuugcugacacuuuuggccacagucacgggcggaaucuuuuuauucuugaugaguggaaaagguauagggaaaaugacccugggaaugugcugcauaaucacggccaguauucuccuaugguacgcacaaauacagccacacuggauagcggcuucaauaauacuggaguucuuucucauagucuugcucauuccagagccagaaaagcagagaacaccccaagauaaccaauugacuuacguugucauagccauccucacagugguggccgcaaccauggcaaaugagaugggguucuuggaaaaaacgaagaaagauuucggauugggaagcauugcaacccagcaacucgagagcaacauccuggacauagaucuacguccugcaucagcauggacccuguaugcaguggccacaacauuuaucacaccaaugcugagacauagcauugaaaauuccucagugaaugugucucuaacagcuauugccaaucaagccacagugcuaaugggucuugggaagggauggccauugucaaaaauggacauuggaguuccccuucucgccaucgggugcuauucacaagucaaccccauaacccucacagcagcccuucuucuauugguagcacauuaugcuaucauagggccaggacuccaagcaaaagcaaccagagaagcgcagaaaagagcagcagcaggcaucaugaaaaacccaacuguggauggaauaacagugauugaccuagauccaauacccuaugauccaaaauuugagaagcagcugggacaaguaaugcucuuaguccucugcgugacucaaguacugaugaugaggacuacaugggcuuugugugaggcucuaacccuagccaccgggcccaucuccacauugugggaaggaaauccagggagauuuuggaauacaaccauugcagugucaauggcuaacauuuuuagaggaaguuacuuggcuggagcuggacuucucuuuuccauuaugaagaacacaaccaacacaagaaggggaacuggcaacacaggagagacgcuuggagagaaauggaaaaaccgauugaauucauuggggaagagugaauuccagaucuacaagagaagcggaauccaggaaguggauagaaccuuggcaaaagaaggcauuaaaagaggagaaacggaccaucacgcugugucgcgaggcucggcaaagcugagaugguucgucgagagaaaccuggucacaccagaggggaaaguaguggaccucgguugcgguagaggaggcuggucauacuauugugggggucuaaagaauguaagagaagucaaaggccuaacaaaaggaggaccaggacacgaagagcccauucccaugucaacauauggguggaaccuugugcgucuccaaaguggaguugauguuuucuuuacuccgccagaaaagugugacacauuguugugugacauaggggagucgucaccaaaccccacaguugaagcaggacgaacacucagaguccuaaacuugguagaaaauuggcugaacaacgacacccaauuuugcauaaagguucuuaacccauacaugccuucagucauagaaaaaauggaagcgcugcaaagaaaauacggaggagcuuuggugaggaauccacucucgagaaauucuacacaugagauguauuggguauccaaugcuuccgggaacauagugucaucagugaacaugauuucaaggauguugaucaauagauuuacaaugagacauaagaaggccacauacgagccagauguugaccucggaagcggaacccgcaacaucggaauugaaagcgagacaccaaaccuagacauaauugggaaaagaauagaaaaaauaaaacaagagcaugagacaucauggcauuaugaccaagaccacccauacaaaacgugggccuaucaugguagcuacgaaacaaaacagacuggaucagcaucauccauggugaauggaguaguuagauugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuaggaaagaaaaagacaccuagaaugugcacuagagaagaauucacaagaaaggugagaagcaaugcagccuugggugccauauucacugaugagaacaaguggaagucggcacgugaggcuguugaagacaguagauuuugggaacugguuaacaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuccugaaugaagaucacugguuuuccagagagaacucucugagcggaguggaaggagaagggcugcacaagcuggguuacauucuaagagaagugaguaagaaagaaggaggagcaauguacgccgacgacacugcuggaugggacacaagaaucacacuagaggacuuaaaaaaugaagaaauggugacaaaccacauggaaggagaacacaagaaacuugcugaggccauuuucaaauugacguaccagaacaagguggugcgugugcaaagaccgacaccaagaggcacuguaauggauauuauaucgagaagagaccaaagagguaguggacaaguuggcaccuauggccucaacaccuucaccaauaugggagcccaacuaaucagacagauggagggagaaggagucuuuaagggcauccagcaccugacagccacagaagaaaccgcagugcaugacuggcuagcaagaguggggcgugagagguuaucaagaauggccaucaguggagaugauuguguugugaaacccuuagaugacagguuugcaagcgcuuuaacagcucuaaacgacaugggaaagguuaggaaagacauacaacaaugggaaccuucaagaggauggaaugacuggacacaagugccuuucuguucacaccacuuccaugaguuaaucaugaaagacggucguguacucguaguuccauguagaaaccaagaugaacuaauugguagagcccgaauuucccagggagccggguggucuuugcgggagacggccugucugggaaagucuuacgcccaaauguggagccugauguacuuccacagacgugaccucaggcuggcggcaaacgcuauuugcucggcagucccaucacauuggguuccaacaagucgaacaaccugguccauacacgccagacaugaauggaugacaacagaagacaugcugacagucuggaacaggguguggauucaagaaaacccauggauggaagacaaaacuccaguggaaucaugggaggaaaucccauacuuggggaaaagagaagaccaaugguguggcucacugauagggcuaacaagcagagcuaccugggcaaagaacauccaaacagcaauaaaccaaguuagauccuuaauaggcagugaggaauacacagacuauaugccauccaugaaaagauucagaagagaagaggaagaggcaggggucuugugguag

SEQ ID NO: 7066 - RNA, 9876 nt, Artificial Sequence
  derived and/or modified CDS sequence (wt) from DENV-2__KR779782__SS-prME
acugcagguauaauuauuaugaugaucccaacagugauggcguuccauuuaaccacacgcaacggagaaccacacaugaucguuagcagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaacaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccaaaugcagugauauugcaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagaacgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauuugcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaauguguugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacauuggaguuccccuucucgcuaucgggugcuauucacaagucaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguuaggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaaucgaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguuuggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaaacuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7067 - RNA, 9876 nt, Artificial Sequence
  derived and/or modified CDS sequence (wt) from DENV-2__KM279608__SS-prME
acugcagguauaauuauuaugaugaucccaacagugauggcguuccacuuaaccacacgcaacggagaaccacacaugaucgugaguagacaagagaaggggaaaagucuccuguuuaaaacagagaacggugugaacauguguacccucauggccauggaccuuggugaacugugugaagacacaaucacauauaacuguccucuucucaggcagaaugaaccagaagacauagacuguuggugcaacucuacgucuacauggguaacuuaugggacaugcaccgucacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauaccuccaaagaguccugauuuucauuuuacugacagcugucacuccuucaauggcaaugcguuguauaggaauaucaaauagagacuuuguggaagggguuucaggaggaagcugggucgauauagucuuggaacauggaagcugugugacgacgauggcgaaaaauaaaccaacauuggauuuugaacugauaaaaacagaagccaaacaucccgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggucucgacuucaaugagaugguguugcugcaaauggaaaacaaggcuuggcuggugcacaggcaaugguucuuagaccugccguuaccaugguugcccggagcagacacacaaggaucaaauuggauacagaaggagacacuggucaccuucaaaaauccccaugcaaagaaacaggauguuguuguuuuaggaucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacaacccagucaacauagaagcagaaccuccauuuggagacagcuacaucauuauaggaguagaaccgggacaacugaagcucagcugguauaagaaaggaaguucuauuggccaaauguuugagacaacaaugagaggagcgaagagaauggccauuuuaggugacacagcuugggauuuuggaucccugggaggaguguucacauccauaggaaaggcccuccaccaagucuuuggagcuaucuauggggcugccuucagcgggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggagaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacggaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguguucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcgauauuacuaguugcagucucuuucgugacauugaucacagggaauauguccuuucgagauuuggggagagugauggucauggugggcgcuacuaugacggaugacauaggcaugggcgugacuuaucuugcccuauuagcagccuucaaaguuagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccgaaugcagugauauuggaaaacgcauggaaagugagcugcacaacacuggcagugguguccgucuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugacauucccaugacaggaccauuaguggcuggagggcuucucacuguguguuacgugcucacuggaagaucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucaccgccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaguggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcagggaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacaguuugguuuguuccaaguauaaaagcagggaaugauauagcagcuugccugagaaagaauggaaagaaagugauacaacucagcaggaagacuuuugauucugaauauaucaagacuaggaccaaugauugggacuuuguggucacgacagacauuucagaaaugggugcuaacuucaaggcugagaggguuauagaccccagacgcugcaugaaaccagucauauuaacggacggugaagagcgggugauuuuggcaggacccaugccagugacccauucuagugcagcacaaagaagagggagaguaggaagaaauccaaaaaaugaaaaugaccaguacauauacaugggggaaccucuggaaaaugaugaagacugugcacauuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacaaaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuuuaugacccagaaagcaaagaaugcacucgacaacuuagcaguucugcauacggcugaagcaggcggaagggcguacaaucaugcucuuagugaacugccggagacucuggagacauugcuuuuacugacacuuuuggccacagucacgggcggaaucuuccuguuuuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaaccuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaaguuaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuggggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaagugguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugacguuuuuuuuacuccgccagaaaagugugacacauugcugugugacauaggggagucgucaccaaaccccacgguugaggcaggacgaacacucagaguucuaaacuuaguggaaaauuggcugaacaacaacacccaauuuugcauaaagguucucaacccauacaugccuucaguuauagagaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacgaugagacacaagaaagccacauacgagccagauguugaccucggaaguggaacccgcaacaucggaauugaaagugagacaccaaauuuagacauaauugggaaaagaauaaaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagcccuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaaacuaggggaguucggcaaagcaaaaggcagcagagccauaugguacauguggcuuggagcacgcuucuuagaguuugaagcucuaggauucuugaaugaagaucacugguuuuccagagagaacucccugaguggaguggaaggagaagggcuacacaaacuaggcuacauuuuaagggacgugaguaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacaucauaucgagaagagaccaaagagguaguggacaaguugucaccuacggccucaauacuuucaccaauauggaagcccaacugaucagacagauggaaggagaaggagucuucaaaagcauccagcaacugacaguuaaagaagaaauugcagugaaaaacugguuaauaagaguggggcgugagagguuaucaagaauggcuaucaguggagaugauuguguugugaaacccuuagaugacagguuugcaagugcucuaacagcucuaaaugacaugggaaaaguuaggaaagacauacaacaaugggaaccuucaagaggauggaacgauuggacacaagugcccuuuuguucacaccauuuccaugaguugaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagagucaugggaggaaaucccguauuuggggaaaagagaagaccaauggugcggcucauugauugggcugacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7068 - RNA, 9876 nt, Artificial Sequence
  derived and/or modified CDS sequence (wt) from DENV-2__KM279605__SS-prME
acugcagguauaauuauuaugaugaucccaacagugauggcguuccacuuaaccacacgcaacggagaaccacacaugaucgugaguagacaagagaaggggaaaagucuccuguuuaaaacagagaacggugugaacauguguacccucauggccauggaccuuggugaacugugugaagacacaaucacauauaacuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauacuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacauuggauuuugaacugauaaaaacagaagccaaacaucccgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggucucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuaggaucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacaacccagucaacauagaagcagaaccuccauuuggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacauccauaggaaaggcccuccaccaagucuuuggagcuaucuauggggcugccuucagcgggguuucauggacuaugaaaauccucauaggagucgucaucacauggauaggaaugaauucacgcagcaccucacugucugugucacuaguauuagugggggucgugacauuguauuugggaguuauggugcaggccgauagugguuguguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacggaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguguucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaauauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccaaaugcagugauauuggaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugacauucccaugacaggaccauuaguggcuggagggcuucucacuguguguuacgugcucacuggaagaucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucaccgccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaguggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaagacuuuugauucugaauauaucaagacuaggaccaaugauugggacuuuguggucacgacagacauuucagaaaugggugcuaacuucaaggcugagaggguuauagaccccagacgcugcaugaaaccagucauauuaacggacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacauuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacaaaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguuuuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaaguuaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuggggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacauugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaaugaagaucacugguuuuccagagagaacucccugaguggaguggaaggagaagggcuacacaaacuaggcuacauuuuaagggacgugaguaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacaucauaucgagaagagaccaaagagguaguggacaaguugucaccuacggccucaauacuuucaccaauauggaagcccaacugaucagacagauggaaggagaaggagucuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaaaguuaggaaagacauacaacaaugggaaccuucaagaggauggaacgauuggacacaagugcccuuuuguucacaccauuuccaugaguugaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagagucaugggaggaaaucccguauuuggggaaaagagaagaccaauggugcggcucauugauugggcugacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7069 - RNA, 9876 nt, Artificial Sequence
  derived and/or modified CDS sequence (wt) from DENV-2__KM279609__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucucgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacaguuacaucauuauaggaguagaaccaggacaacugaagcucagcugguuuaagaaaggaaguucuauuggccaaauguuugagacaacaaugagaggagcgaagagaauggccauucuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguuguguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaggcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccaguuucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaaccuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggcaaucuugugcgucccaaaugcagugauauugcaaaaugcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagcuaguucucucuuaaagaaugauauucccaugacaggaccauuaguggcuggagggcuucucacuguguguuacgugcucacuggaaggucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucaucagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucaugccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagccaccccuccuggaagcagagacccauuuccccagagcaacgcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucccuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggggagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuucacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacugcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguaaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggauuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7070 - RNA, 9876 nt, Artificial Sequence
  derived and/or modified CDS sequence (wt) from DENV-2__KM279607__SS-prME
acugcagguauaauuauuaugaugaucccaacagugauggcguuccacuuaaccacacgcaacggagaaccacacaugaucgugaguagacaagagaaggggaaaagucuccuguuuaaaacagagaacggugugaacauguguacccucauggccauggaccuuggugaacugugugaagacacaaucacauauaacuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuagagacacgaacugaaacauggaugucaucagaaggggccuggaaacaugcccagagaauugaaacuuggaucuugagacauccaggcuucaccauaauggcagcaauccuggcauacaccauaggaacaacauaccuccaaagaguccugauuuucauuuuacugacagcugucacuccuucaauggcaaugcguuguauaggaauaucaaauagagacuuuguggaagggguuucaggaggaagcugggucgauauagucuuggaacauggaagcugugugacgacgauggcgaaaaauaaaccaacauuggauuuugaacugauaaaaacagaagccaaacaucccgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggucucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuaggaucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacaacccagucaacauagaagcagaaccuccauuuggagacagcuacaucauuauaggaguagaaccgggacaacugaagcucagcugguauaagaaaggaaguucuauuggccaaauguuugagacaacaaugagaggagcgaagagaauggccauuuuaggugacacagcuugggauuuuggaucccugggaggaguguucacauccauaggaaaggcccuccaccaagucuuuggagcuaucuauggggcugccuucagcgggguuucauggacuaugaaaauccucauaggagucgucaucacauggauaggaaugaauucacgcagcaccucacugucugugucacuaguauuagugggggucgugacauuguauuugggaguuauggugcaggccgauagugguuguguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacggaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguguucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaauauguccuuucgagauuuggggagagugauggucauggugggcgcuacuaugacggaugacauaggcaugggcgugacuuaucuugcccuauuagcagccuucaaaguuagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccgaaugcagugauauuggaaaacgcauggaaagugagcugcacaacacuggcagugguguccgucuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugacauucccaugacaggaccauuaguggcuggagggcuucucacuguguguuacgugcucacuggaagaucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucaccgccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaguggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaagacuuuugauucugaauauaucaagacuaggaccaaugauugggacuuuguggucacgacagacauuucagaaaugggugcuaacuucaaggcugagaggguuauagaccccagacgcugcaugaaaccagucauauuaacggacggugaagagcgggugauuuuggcaggacccaugccagugacccauucuagugcagcacaaagaagagggagaguaggaagaaauccaaaaaaugaaaaugaccaguacauauacaugggggaaccucuggaaaaugaugaagacugugcacauuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacaaaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuuuaugacccagaaagcaaagaaugcacucgacaacuuagcaguucugcauacggcugaagcaggcggaagggcguacaaucaugcucuuagugaacugccggagacucuggagacauugcuuuuacugacacuuuuggccacagucacgggcggaaucuuccuguuuuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaaguuaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuggggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugacguuuuuuuuacuccgccagaaaagugugacacauugcugugugacauaggggagucgucaccaaaccccacgguugaggcaggacgaacacucagaguucuaaacuuaguggaaaauuggcugaacaacaacacccaauuuugcauaaagguucucaacccauacaugccuucaguuauagaaaaaauggaagcacuacaaaggaaauacggaggagcuuuggugaggaauccacucucacgaaauuccacacacgagauguauuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaagcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaaacuaggggaguucggcaaagcaaaaggcagcagagccauaugguacauguggcuuggagcacgcuucuuagaguuugaagcucuaggauucuugaaugaagaucacugguuuuccagagagaacucccugaguggaguggaaggagaagggcuacacaaacuaggcuacauuuuaagggacgugaguaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacaucauaucgagaagagaccaaagagguaguggacaaguugucaccuacggccucaauacuuucaccaauauggaagcccaacugaucagacagauggaaggagaaggagucuucaaaagcauccagcaacugacaguuaaagaagaaauugcagugaaaaacugguuaauaagaguggggcgugagagguuaucaagaauggcuaucaguggagaugauuguguugugaaacccuuagaugacagguuugcaagugcucuaacagcucuaaaugacaugggaaaaguuaggaaagacauacaacaaugggaaccuucaagaggauggaacgauuggacacaagugcccuuuuguucacaccauuuccaugaguugaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagagucaugggaggaaaucccguauuuggggaaaagagaagaccaauggugcggcucauugauugggcugacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7071 - RNA, 9876 nt, Artificial Sequence
  derived and/or modified CDS sequence (wt) from DENV-2__KM279606__SS-prME
acugcagguauaauuauuaugaugaucccaacagugauggcguuccacuuaaccacacgcaacggagaaccacacaugaucgugaguagacaagagaaggggaaaagucuccuguuuaaaacagagaacggugugaacauguguacccucauggccauggaccuuggugaacugugugaagacacaaucacauauaacuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauacuuccaaagaguccugauuuucauuuuacugacagcugucacuccuucaauggcaaugcguuguauaggaauaucaaauagagacuuuguggaagggguuucaggaggaagcugggucgauauagucuuggaacauggaagcugugugacgacgauggcgaaaaauaaaccaacauuggauuuugaacugauaaaaacagaagccaaacaucccgccacucuaaggaaguauuguguagaggcaaagcugaccaacacaacaacagcaucucgcugcccaacacaaggagaaccuagccuaaaugaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggucucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuaggaucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacaacccagucaacauagaagcagaaccuccauuuggagacagcuacaucauuauaggaguagaaccgggacaacugaagcucagcugguauaagaaaggaaguucuauuggccaaauguuugagacaacaaugagaggagcgaagagaauggccauuuuaggugacacagcuugggauuuuggaucccugggaggaguguucacauccauaggaaaggcccuccaccaagucuuuggagcuaucuauggggcugccuucagcgggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacggaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuaugguuuuggaguguucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaauauguccuuucgagauuuggggagagugauggucauggugggcgcuacuaugacggaugacauaggcaugggcgugacuuaucuugcccuauuagcagccuucaaaguuagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccaaaugcagugauauuggaaaaugcauggaaagugagcugcacaacacuggcagugguguccgucuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugacauucccaugacaggaccauuaguggcuggagggcuucucacuguguguuacgugcucacuggaagaucggcugacuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucaccgccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaguggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaagacuuuugauucugaauauaucaagacuaggaccaaugauugggacuuuguggucacgacagacauuucagaaaugggugcuaacuucaaggcugagaggguuauagaccccagacgcugcaugaaaccagucauauuaacggacggugaagagcgggugauuuuggcaggacccaugccagugacccauucuagugcagcgcaaagaagagggagaguaggaagaaauccaaaaaaugaaaaugaccaguacauauacaugggggaaccucuggaaaaugaugaagacugugcacauuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacaaaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuuuaugacccagaaagcaaagaaugcacucgacaacuuagcaguucugcauacggcugaagcaggcggaagggcguacaaucaugcucuuagugaacugccggagacucuggagacauugcuuuuacugacacuuuuggccacagucacgggcggaaucuuccuguuuuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuauugggugcuauucacaaguuaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggccaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuggggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugacguuuuuuuuacuccgccagaaaagugugacacauugcugugugacauaggggagucgucaccaaaccccacgguugaggcaggacgaacacucagaguucuaaacuuagcggaaaauuggcugaacaacaacacccaauuuugcauaaagguucucaacccauacaugccuucaguuauagaaaaaauggaagcacuacaaaggaaauacggaggagcuuuggugaggaauccacucucacgaaauucuacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaaacuaggggaguucggcaaagcaaaaggcagcagagccauaugguacauguggcuuggagcacgcuucuuagaguuugaagcucuaggauucuugaaugaagaucacugguuuuccagagagaacucccugaguggaguggaaggagaagggcuacacaaacuaggcuacauuuuaagggacgugaguaagaaagaaggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacaucauaucgagaagagaccaaagagguaguggacaaguugucaccuacggccucaauacuuucaccaauauggaagcccaacugaucagacagauggaaggagaaggagucuucaaaagcauccagcaacugacaguuaaagaagaaauugcaguaaaaaacugguuaauaagaguggggcgugagagguuaucaagaauggcuaucaguggagaugauuguguugugaaacccuuagaugacagguuugcaagugcucuaacagcucuaaaugacaugggaaaaguuaggaaagacauacaacaaugggaaccuucaagaggauggaacgauuggacacaagugcccuuuuguucacaccauuuccacgaguugaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagagucaugggaggaaaucccguauuuggggaaaagagaagaccaauggugcggcucauugauugggcugacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7072 - RNA, 9876 nt, Artificial Sequence
  derived and/or modified CDS sequence (wt) from DENV-2__JN851113__SS-prME
acugcagguauaauuauuaugaugaucccaacagugauggcguuccauuuaaccacacgcaacggagaaccacacaugaucguuaguagacaagagaaggggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccaaaugcagugauauugcaaaacgcauggaaagugagcugcacaacacuggcagugguguccguuuccccacugcuuuuaacauccucacagcagaaagcggauuggauaccacuggcguugacgaucaaaggccucaauccaacagccaucuucuuaacaacucucucaagaacuagcaagaaaaggagcuggccacuaaaugaggcuauuauggcagucgggauggugagcauucuagccaguucucucuuaaagaaugauauucccaugacaggaccauuaguggcuggagggcuccucacuguguguuaugugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcucuuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauguugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaauaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaaacuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguuccaugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7073 - RNA, 9876 nt, Artificial Sequence
  derived and/or modified CDS sequence (wt) from DENV-2__GU370050__SS-prME
acugcagguauaauuauuaugaugaucccaacagugauggcguuccauuuaaccacacgcaacggagaaccacacaugaucguuaguagacaagagaaagggaaaagucuccuguuuaaaacagagaacggugugaacauguguacccucauggccauggaccuuggugaacugugugaagacacaaucacuuauaauuguccucuucucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuuggaucuugagacauccaggcuucaccauaauggcagcaauccuggcauacaccauaggaacaacauauuuccaaagaguccugauuuucauuuuacugacagcugucacuccuucaauggcaaugcguuguauaggaauaucaaauagagacuuuguggaagggguuucaggaggaagcuggguugauauagucuuggaacauggaagcugugugacgacgauggcgaaaaauaaaccaacguuggauuuugaacugauaaaaacagaagccaaacaucccgccacucuaaggaaguauuguguagaggcaaagcugaccaacacaacaacagcaucucgcugcccaacacaaggagaaccuagccuaaacgaagaacaggacaaaagauucgucugcaaacacuccaugguagacagaggauggggaaauggaugcggauuauuuggaaagggaggcaucgugaccugugcaauguucacaugcaaaaagaacauggaaggaaaagucgugcaaccagaaaacuuggaguacaccaucgugauaacaccucacucaggggaagagaaugcagucggaaaugacacaggaaaacauggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacacuggucacuuucaaaaauccccaugcaaagaaacaggauguuguuguuuuagguucccaagaaggggccaugcacacggcacucacaggggccacggaaauccagaugucaucaggaaacuuacuguucacaggacaucuuaagugcaggcugagaauggacaaacuacagcucaaaggaaugucauauuccauguguacaggaaaguucaaaguugugaaggaaauagcagaaacacaacauggaacaauaguuauuagaguacaauaugaaggggacgguucuccgugcaagaucccuuuugaaauaauggacuuggaaaaaaggcaugucuuaggucgcuugauuacagucaacccaauugucacagaaaaagacagcccagucaacauagaagcagaaccuccauuuggagacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcuaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaaugugguagugggauuuuuaucacagacaacgugcacacauggacagaacaauacaaauuccaaccagaauccccuucaaagcuggcuucagcuauccagaaggcucaugaagaaggcauuuguggaauccgcucaguaacaagacuggagaaucugauguggaaacaaauaacaccagaauugaaucacauucuaacagaaaaugaaguaaaguugacuaucaugacaggagacaucaaaggaaucaugcaggcaggaaaacgaucccugcggccucaacccacugagcugaaguacuccuggaaagcauggggcaaagcgaaaaugcuuuccacagagcuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguguuuugugacucaaaacucaugucagcagccauaaaggacaauagagccguccacgccgauauggguuauuggauagaaagcgcacucaaugacacauggaagauugagaaagccucuuuuauugaaguuaaaagcugccacuggccaaagucacacacucucuggaguaauggagugcuggaaagugagaugauaauuccaaagaauuuugcaggaccagugucacaacacaauuacagaccaggcuaccacacacaaacggcaggacccuggcaucuagguaggcuugagauggacuuugauuucugcgaaggaaccacagugguggugacugaggacuguggaaauagaggacccuccuuaagaacaacuacugcuucuggaaaacucauaacagaguggugcugccgaucuugcacauuaccaccgcuaagguacagaggugaggauggaugcugguaugguauggaaaucaggccauugaaagagaaagaagagaacuuggucaacucuuuggucacagccggacauggacagauugacaacuucucacuaggagucuugggaauggcauuguuccuggaagagaugcucaggacucgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcggcuggacuacucuuaagaaagcugaccuccaaggaauugaugaugaccaccauaggaaucguacuccucucucagaguaccauaccagagagcauacuugaacugacugacgcguuggcuuuggggaugaugguucucaaaauagugagaaacauggaaaaguaucagcuagcagugacuaucauggccaucuugugcgucccaaaugcagugauauugcaaaacgcauggaaagugagcugcacaacacuggcagugguguccguuuccccacugcuuuuaacauccucacagcagaaagcggauuggauaccacuggcguugacgaucaaaggccucaauccaacagccauuuucuuaacaacucucucaagaacuagcaagaaaaggagcuggccacuaaaugaggcuauuauggcagucgggauggugagcauucuagccaguucucucuuaaagaaugauauucccaugacaggaccauuaguggcuggagggcuucucacuguguguuacgugcucacuggaagaucggcugauuuggaacuggaaagagcugcugacguaagaugggaagaacaggcagagauaucaggaaguaguccaauucugucgauaacaauaucggaagaugguagcaugucgauaaagaaugaagaagaagaacagacacugaccauacucauuagaacaggacuacuggugauaucaggacuuuuuccugugucaauaccaaucacggcagcugcaugguaccuuugggaagugaaaaaacaacgagcaggaguauugugggaugucccuucacccccaccugugggaaaggccgaacuggaagauggagccuauagaaucaagcagaaagggauccuaggauacucacagauuggagccggaguuuacaaagaaggaacauuccacacaauguggcaugucacacguggugcugucuuaaugcauaaagggaagagaauugaaccaucaugggcggacgucaagaaagaccuaauaucguauggaggaggcuggaagcuggaaggagaauggaaggaaggagaagaaguccagguccuggcauuagagccuggaaagaauccaagagccguccaaacaaaacccggucuuuuuaaaaccaacacuggaaccauaggcgccgugucucuggacuuuucuccuggaacgucaggaucuccaaucgucgauaaaaaaggaaaaguugugggccuuuauggcaacggugucgucacaaggaguggaacauaugugagugccauagcccagacugaaaaaagcaucgaagacaauccagagauugaagaugacaucuuuagaaagaaaagauugaccaucauggaccuccacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuauuaucaccaauuagagugccaaauuacaaccugaucaucauggaugaagcccauuucacagacccagcaagcauagcagcuagaggauacauuucaacucgaguagagaugggugaagcagcugggauuuucaugacagcuaccccuccuggaagcagagacccauuuccccagagcaaugcaccaaucauggaugaagaaagagaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaaaacuuuugauucugaauauaucaagacuaggaccaaugauugggacuuuguggucacgacagacauuucagaaaugggugcuaacuucaaggcugagaggguuauagaccccagacgcugcaugaaaccagucauauuaacagacggugaagagcgggugaucuuggcaggacccaugccagugacccauucuagugcagcacaaagaagagggagaguaggaagaaauccaaaaaaugaaaaugaccaguacauauacaugggggaaccucuggaaaaugaugaagacugugcacacuggaaagaagcuaagaugcuccuggauaacaucaacacgccugaaggaaucauucccagcauguucgaaccagagcgugaaaagguggaugccauugauggugaauaccgcuugagaggagaagcgaggaaaacuuuuguggaccuaaugagaagaggagauuuaccagucuggcuagccuacagaguggcggcugaaggcaucaacuacgcagacagaagauggugcuuugauggagucaagaacaaccaaaucuuggaagaaaauguggaaguagaaauuuggacaaaagaaggagaaaggaagaaauuaaaacccagaugguuggaugcuaggaucuacucugacccauuggcgcucaaagaauucaaggaauucgcagcuggaagaaagucccugacccugaaucuaaucacagagauggguagacucccaaccuucaugacccagaaagcaaagaaugcacucgacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggcuaguauccucuuaugguaugcacaaauacagccacacuggauagcagcuucaauaauacuggaguuuuuucucauagucuugcucauuccagaaccagaaaaacagagaacaccccaagauaaccaguuaacuuauguugucauagccauccuuacaguaguggccgcaaccauggcaaacgagauggguuuccuggaaaaaacaaagaaagauuucggauugggaagcauuacaacccagcaaccugagaguaacauccuggacauagaucuacguccugcaucagcuuggacucuauaugccguggcaacaacuuucaucacaccaauauugaggcauagcauugaaaacuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacugcagcccuucucuuauugguagcccauuaugcuaucauagggccaggacuccaagcgaaagcaacuagagaggcucagaaaagagcagcagcgggcaucaugaaaaacccaacuguggauggaaugacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuuuucuaucaugaaaaacacggccaacacaagaaggggaacuggcaacacaggagagacgcuuggagagaaauggaaaaaccgguugaaugcauuagggaagagugaauuccagaucuacaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaaguuaaaggccuaacaaaaggaggaccaggacacgaagaacccauucccaugucaacauaugguuggaaucuggugcgucuucaaaguggaguugauguuuuuuuuacuccgccagaaaagugugacacacugcugugugacauaggggagucgucaccaaaccccacgguugaggcaggacgaacacucagaguucuaaacuuaguggaaaauuggcugaacaacaacacccaauuuugcauaaagguucucaacccauacaugcccucaguuauagaaaaaauggaagcacuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacacaagaaagccacauacgagccagauguugaccucggaaguggaacccgcaacaucggaauugaaagugagacaccaaauuuagacauaauugggaaaagaauagaaaaaauaaaacaagagcauaaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaauuacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaauugguugacaaggaaaggaaucuccaucuugaaggaaagugugaaacauguguguauaacaugaugggaaagagagagaagaagcuaggggaguucggcaaagcaaaaggcagcagagccauaugguacauguggcuuggagcacgcuucuuagaguuugaagcucuaggauucuugaacgaagaucacugguuuuccagagagaacucccugaguggaguggaaggagaagggcuacacaagcuaggcuacauuuuaagagacgugaguaagaaagaaggaggagcaauguaugcugaugacaccgcaggaugggacacaagaaucacacuagaggacuuaaaaaaugaagaaauggugacaaaccacauggaaggagaacacaagaaacuugcugaagccauuuucagauuaacguaccaaaacaagguggugcgugugcaaagaccaacaccaagaggcacaguaauggacauuauaucgagaagagaccaaagagguaguggacaaguugucaccuacggccucaauacuuucaccaauauggaagcccaacugaucagacagauggagggagaaggaguuuucaaaagcauccagcaacugacaguuaaagaagaaauugcagugaaaaacugguuaauaagaguggggcgugagagguuaucaagaauggccaucaguggagaugauuguguugugaaacccuuagaugacagguuugcaagugcucuaacagcucuaaaugacaugggaaagguuaggaaagacauacaacaaugggaaccuucaagaggauggaacgauuggacacaagugcccuuuuguucacaccauuuccaugaguuaaucaugaaggacggucgugugcucguaguucccugcagaaaccaagaugaacugauugguagggcccgaauuucccagggagccgggugguccuugcgggaaacagccugucuggggaaguccuacgcccaaauguggagccugauguacuuccacagacgugaccuuaggcuggcggcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccaucuaugaaaagauucagaagagaagaggaagaggcaggagucuugugguag

SEQ ID NO: 7074 - RNA, 9876 nt, Artificial Sequence
  derived and/or modified CDS sequence (wt) from DENV-2__JN851129__SS-prME
acugcagguauaauuauuaugaugauuccaacagugauggcguuccauuuaaccacacgcaacggagaaccacauaugaucgucaguagacaagagaaagggaaaagucuucuguuuaaaacagagaacggugugaacauguguacccucauggccauggaccuuggugaauugugugaagacacaaucacuuauaauuguccucuucucaggcagaaugaaccagaagacauagacuguuggugcaauucuacgucuacauggguaacuuaugggacgugcaccgccacaggagaacacagaagggaaaaaagaucaguggcacucguuccacauguaggaaugggacuggagacacgaacugagacauggaugucaucagaaggggccuggaaacaugcccagagaauugaaacuugggucuugagacauccaggcuuuaccauaauggcagcaauccuggcauacaccauaggaacgacauauuuccaaagaguccugauuuucaucuuacugacagcugucgcucccucaaugacaaugcguuguauaggaauaucaaauagagacuuuguggaaggggucucaggaggaagcuggguugacauagucuuggaacauggaagcugugugacgacgauggcgaaaaauaaaccaacauuggauuuugaacugauaaaaacagaggccaagcaucccgccacucuaaggaaguauuguauagaggcaaagcugaccaacacaacaacagcuucucgcugcccaacacaaggagaaccuagccuaagugaagaacaggacaaaagauuugucugcaaacacuccaugguagacagaggauggggaaauggaugcggauuauuuggaaaaggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcuccccgagaacgggccucgacuucaaugagaugguguugcugcaaauggaaaacaaggcuuggcuggugcacaggcaaugguucuuagacuugccguugccaugguugcccggagcagacacacaaggaucaaauuggauacagaaggagacauuggucacuuucaaaaauccccacgcaaagaaacaggauguuguugucuuaggaucccaagaaggggcuaugcacacagcacucacaggggcuacggaaauccagaugucaucaggaaacuuacuguucacaggacaccuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccguguaagaucccuuuugaaauaauggauuuggaaaaaagacaugucuuaggucgcuugauuacagucaacccaauugucacagaaaaagacagcccaguaaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaaugugcacacauggacagaacaauacaaauuccaaccagaauccccuucaaagcuggcuucagcuauucagaaggcucaugaagaaggcauuuguggaauucgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacuuauggcugaaauugaaagaaaggcaggauguauuuugugacucaaaacucaugucggcagccauaaaagacaacagagccguccacgccgauauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaguuuugcaggaccagugucacaacacaauuacagaccaggcuaucauacacaaacggcaggacccuggcaucuagguaggcuugagauggacuuugauuucugcgaaggaacuacagugguggugacugaggacuguggaaauagaggacccucuuuaagaacaacuacugcuucuggaaaacucauaacagaguggugcugccgaucuugcacauuaccaccgcuaagguacagaggugaggauggaugcugguauggaauggaaaucagaccauugaaagagaaagaagagaacuuggucaacuccuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagacuuggggagagugauggucauggugggcgcuacuaugacggaugacauaggcaugggcgugacuuaucuugcccuauuagcagccuucaaaguuagaccaacuuuugcagcuggacuacucuuaagaaagcugaccuccaaggaauugaugaugaccaccauaggaaucguacuccucucucagagcaccauaccggagacuauacuugaacuaaccgacgcguuggccuuggggaugaugguucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcgcugacgaucaaaggccucaauccaacagccaucuucuuaacaacccucucaagaacuagcaagaaaaggagcuggccacugaaugaggcuauuauggcagucgggauggugagcauuuuagccaguucucucuuaaagaaugauauucccaugacaggaccauuaguggcuggagggcuucucacuguguguuacgugcucacuggaagaucggcugacuuggaacuggagagagcugcugacguaagaugggaagaacaagcagagauaucaggaaguaguccaauucuaucgauaacaauaucggaagaugguagcaugucgauaaaaaaugaagaagaagaacaaacacugaccauacucauuagaacaggacugcuggugauaucaggacuuuuucccgugucaauacccaucacggcagcugcaugguaccugugggaagugaaaaaacaacgagcaggaguauugugggaugucccuucacccccaccugugggaaaggccgaacuggaagauggagccuauagaaucaagcagaaagggauucuaggauacucgcagaucggagccggaguuuacaaggaaggaacauuccacacaauguggcaugucacacguggagccguccuaaugcauaaagggaagagaauugaaccaucaugggcggacgucaagaaagaccugauaucguauggaggaggcuggaaguuagaaggagaauggaaggaaggagaagaaguccagguccuggcuuuagagccuggaaagaauccaagagccguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaacggugucgucacaaggaguggaacauaugugagugccauagcccagacugaaaaaagcaucgaagacaauccagagauugaagaugacaucuuucgaaagaaaagauugaccaucauggaccuccacccaggagcaggaaaaacaaaaagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacaccgggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagccaccccuccuggaagcagagacccauuuccucagagcaaugcaccaaucauggaugaagaaagggaaaucccugagcguucguggaacucuggacaugagugggucacggauuuuaaagggaagacuguuugguuuguuccaaguauaaaagcagggaaugauauagcagcuugccugagaaagaauggaaagaaagugauacaacucagcaggaagacuuuugauucugaauauaucaagacuaggacuaaugacugggacuuuguggucacgacagacauuucagaaaugggugcuaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaggcuaagaugcuucuagauaacaucaacacgccugaaggaaucauucccagcauguucgaaccagagcgugaaaagguggacgccauugauggugaauaccgcuugagaggagaagcgaggaaaacuuuuguggaccuaaugagaagaggagaccuaccagucuggcuagccuacagaguggcagcugaagguaucaacuacgcagacagaagauggugcuuugauggaaucaagaacaaccaaaucuuggaagaaaauguggaaguggaaauuuggacaaaagaaggagaaaggaagaaauuaaaacccagaugguuggaugcuagaaucuacucugauccacuggcgcucaaagaauucaaggaauucgcugcuggaagaaaaucccugacccugaaucuaaucacagagauggguaggcucccaaccuucaugacccagaaagcaaggaaugcacuggacaaccuagcaguccugcauacggcugaagcaggcggaagggcguacaaucaugcucuuagugaacugccggagacucuggagacucugcuuuuacugacacuuuuggccacagucacggguggaaucuuccuguucuugaugagcggaaaagguauagggaagaugacucugggaaugugcugcauaaucacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaagcauuacaacccagcaaccugagagcaacauccuggacauagaucuacguccugcaucagcuuggacucuauaugccguggcaacaacuuucaucacaccaauguugaggcauagcauugaaaauuccucagugaaugugucucuaacagccauugccaaccaagcuacagugcuaaugggucuugggaagggauggccauugucaaaaauggacauuggaguuccccuucucgcuaucgggugcuauucacaagucaaccccauaacucucacagcagcccuucucuuauugguagcacauuaugcuaucauaggaccaggacuccaggcgaaagcaacuagagaggcucagaaaagagcagcagcgggcaucaugaaaaacccaacuguggauggaauaacagugauugaccuagauccaauacccuaugauccaaaguuugaaaagcaguugggacagguaaugcucuuaguccucugcgugacucaaguauugaugaugaggacuacaugggcuuuaugugaagcucuaaccuuagcaaccgggcccaucucuacacugugggaaggaaauccagggagauuuuggaacacaacuauugcagugucaauggcuaacauuuuuagagggaguuaccuggccggagccggacuucucuuuuccaucaugaagaacacggccaacacaagaaggggaacuggcaacacaggagagacgcuuggagagaaauggaaaaaccgguugaaugcauugggaaagagugaauuccagaucuauaagaaaaguggaauccaggaaguggauagaaccuuagcaaaagaaggcaucaaaagaggagaaacggaccaucacgcugugucgcgaggcucagcgaaacugagaugguucgucgagagaaacuuggucacaccagaagggaaaguaguggaccuuggcugcggcagggggggcuggucauacuauugugggggacuaaagaauguaaaagaagucaaaggcuuaacaaaaggaggaccaggacacgaagaacccauucccaugucaacauaugguuggaaucuggugcgucuucaaaguggaguugauguuuuuuucacuccgccagaaaagugugacacauugcugugugacauaggggagucgucaccaaaccccacgguugaagcaggacgaacacucagaguucuaaacuuaguggaaaauuggcugaacaacaacacccaauuuugcauaaagguucucaacccauacaugcccucaguuauagaaaaaauggaagcgcuacaaaggaaauacggaggagcuuuggugaggaauccacucucacgaaauuccacacaugagauguacuggguaucuaaugcuuccgggaacauagugucaucagugaacaugauuucaagaauguugauuaacagauucacaaugagacacaagaaggccacguacgagccagauguugaccucggaaguggaacccgcaacaucggaauugaaagugagacaccaaauuuagacauaauugggaaaagaauagaaaaaauaaagcaagagcaugaaacaucauggcacuaugaccaagaccacccauacaaaacgugggccuaccaugguagcuacgaaacaaaacagacuggaucagcaucauccauggugaacggagugguuaggcugcuaacaaaaccuugggacaucaucccuauggugacacagauggcaaugacagacacgacuccauuuggacaacagcgcgucuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagcccuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagaaaagaagcuaggggaguuuggcaaagcaaaaggcagcagagccauaugguacauguggcuuggagcacgcuucuuagaauuugaagcccuaggauuccugaaugaagaucacugguuuuccagagagaacucccugaguggaguggaaggagaagggcugcacaaacuaggcuacauuuuaagagacgugaguaagaaagagggaggagcaauguacgccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacaaauggagggagaaggagucuucaaaaguauccagcaauugacagucacagaagaaauugcagugaaaaacugguuaguaagaguggggcgugagagguuaucaagaauggccaucaguggagaugauuguguugugaaacccuuagaugacagguuugcaagcgcccuaacagcccuaaaugacaugggaaagguuaggaaagacauacaacaaugggaaccuucaagaggauggaacgauuggacacaagugcccuuuuguucacaccauuuucaugaguuaaucaugaaggacggucguguacucguagucccaugcagaaaccaagaugaacugauugguagggcccgaauuucccagggagccggauggucccugcgggaaacagccuguuuggggaagucuuacgcccaaauguggagccugauguacuuccacagacgugaccuuaggcuggcggcaaaugccauuugcucggcagucccaucacacuggguuccaacaagucgaacaaccugguccauacacgccacacaugaguggaugacaacagaagacaugcugacagucuggaacaggguguggauucaagaaaacccauggauggaagacaaaacucuaguagaaucaugggaagaaaucccauauuuggggaaaagagaagaccaauggugcggcucauugauugggcuaacaagcagggccaccugggcgaagaacauccaaacagcgauaaaucaaguuagaucccuaauaggcaaugaggaauacacagacuacaugccauccaugaaaagauucagaagagaagaggaagaggcaggagucuugugguag

SEQ ID NO: 7075 - RNA, 9876 nt, Artificial Sequence
  derived and/or modified CDS sequence (wt) from DENV-2__JN851128__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacccucauggccauggaccuuggugaauugugugaagacacaaucacuuauaauuguccucuucucaggcagaaugaaccagaagacauagacuguuggugcaauucuacgucuacauggguaacuuaugggacgugcaccgccacaggagaacacagaagggagaaaagaucaguggcacucguuccacauguaggaaugggacuggagacacgaacugagacauggaugucaucagaaggggccuggaaacaugcccagagaauugaaacuugggucuugagacauccaggcuuuaccauaauggcagcaauccuggcauacaccauaggaacgacauauuuccaaagaguccugauuuucaucuuacugacagcugucgcucccucaaugacaaugcguuguauaggaauaucaaauagagacuuuguggaaggggucucaggaggaagcuggguugacauagucuuggaacauggaagcugugugacgacgauggcgaaaaauaaaccaacauuggauuuugaacugauaaaaacagaggccaaucaucccgccacucuaaggaaguauuguauagaggcaaagcugaccaacacaacaacagcaucucgcugcccaacacaaggagaaccuagccuaagugaagaacaggacaaaagauuugucugcaaacacuccaugguagacagaggauggggaaauggaugcggauuauuuggaaaaggaggcaucgugaccugugcaauguucacaugcaaaaagaacauggaaggaaaagucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacagguuauggcacugucacgauggaaugcuccccgagaacgggccucgacuucaaugagaugguguugcugcaaauggaaaacaaggcuuggcuggugcacaggcaaugguucuuagaccugccguugccaugguugcccggagcagacacacaaggaucaaauuggauacagaaggagacauuggucacuuucaaaaauccccacgcaaagaaacaggauguuguugucuuaggaucccaagaaggggcuaugcacacagcacucacaggggcuacggaaauccagaugucaucaggaaacuugcuguucacaggacaccuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccguguaagaucccuuuugaaauaauggauuuggaaaaaagacaugucuuaggucgcuugauuacagucaacccaauugucacagaaaaagacagcccagugaacauagaagcagaaccuccauucggagacagcuacaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaacucacgcagcaccucacugucugugucacuaguauuagugggggucgugacauuguauuugggaguuauggugcaggccgauagugguugcguugugaguuggaaaaacaaagaacugaaauguggcagugggauuuuuaucacagacaaugugcacacauggacagaacaauacaaauuccaaccagaauccccuucaaagcuggcuucagcuauucagaaggcucaugaagaaggcauuuguggaauucgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucacuagaaguugaagacuauggcuuuggaguauucaccaccaacuuauggcugaaauugaaagaaaggcaggauguauuuugugacucaaaacucaugucggcagccauaaaagacaacagagccguccacgccgauauggguuauuggauagaaagcgcaaucaaugacacauggaagauugagaaagccucuuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuagguaggcuugagauggacuuugauuucugcgaaggaacuacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacuccuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagacuuggggagagugauggucauggugggcgcuacuaugacggaugacauaggcaugggcgugacuuaucuugcccuauuagcagccuucaaaguuagaccaacuuuugcagcuggacuacucuuaagaaagcugaccuccaaggaauugaugaugaccaccauaggaaucguacuccucucucagagcaccauaccggagacuauacuugaacuaaccgacgcguuggccuuggggaugaugauucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcgcugacgaucaaaggccucaauccaacagccauuuucuuaacaacccucucaagaacuagcaagaaaaggagcuggccacugaaugaggcuauuauggcagucgggauggugagcauuuuagccaguucucucuuaaagaaugauauucccaugacaggaccauuaguggcuggagggcuucucacuguguguuacgugcucacuggaagaucggcugacuuggaacuggagagagcugcugacguaagaugggaagaacaagcagagauaucaggaaguaguccaauucuaucgauaacaauaucggaagaugguagcaugucgauaaaaaaugaagaagaagaacaaacacugaccauacucauuagaacaggacugcuggugauaucaggacuuuuucccgugucaauaccuaucacggcagcugcaugguaccugugggaagugaaaaaacaacgagcaggaguauugugggaugucccuucacccccaccugugggaaaggccgaacuggaagauggagccuauagaaucaagcagaaagggauucuaggauacucgcagaucggagccggaguuuacaaggaaggaacauuccacacaauguggcaugucacacguggagccguccuaaugcauaaagggaagagaauugaaccaucaugggcggacgucaagaaagaccugauaucguauggaggaggcuggaaguuagaaggagaauggaaggaaggagaagaaguccagguccuggcuuuagagccuggaaagaauccaagagccguccaaacaaaacccggucuuuuuaaaacuaacacuggaaccauaggcgccgugucucuggacuuuucuccuggaacgucaggaucuccaaucgucgacaaaaaaggaaaaguugugggucuuuauggcaacgguguugucacaaggaguggaacauaugugagugccauagcccagacugaaaaaagcaucgaagacaauccagagauugaagaugacaucuuucgaaagaaaagauugaccaucauggaccuccacccaggagcaggaaaaacaaaaagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacaccgggcgggagauuguggaucuaaugugucacgccacauuuaccaugaggcuacuaucaccaauuagagugccaaacuacaaccugauuaucauggaugaagcccauuucacagacccagcaagcauagcagcuagaggauacauuucaacucgaguagagaugggugaagcagcugggauuuucaugacagccaccccuccuggaagcagagacccauuuccucagagcaaugcaccaaucauggaugaagaaagggaaaucccugagcguucguggaacucuggacaugaguggguuacggauuuuaaagggaagacuguuugguuuguuccaaguauaaaagcagggaaugauauagcagcuugccugagaaagaauggaaagaaagugauacaacucagcaggaagacuuuugauucugaauauaucaagacuaggacuaaugacugggacuuuguggucacgacagacauuucagaaaugggugcuaacuucaaggcugagaggguuauagaccccagacgcugcaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaggcuaagaugcuucuagauaacaucaacacgccugaaggaaucauucccagcauguucgaaccagagcgugaaaagguggacgccauugauggugaauaccgcuugagaggagaagcgaggaaaacuuuuguggaccuaaugagaagaggagaccuaccagucuggcuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauuaaaacccagaugguuggaugcuagaaucuacucugauccacuggcgcucaaagaauucaaggaauucgcugcuggaagaaaaucccugacccugaaucuaaucacagagauggguaggcucccaaccuucaugacccagaaagcaaggaaugcacuggacaaccuagcaguccugcauacggcugaagcaggcggaagggcguacaaucaugcucuuagugaacugccggagacucuggagacucugcuuuuacugacacuuuuggccacagucacgggcggaaucuuccuguucuugaugagcggaaaagguauagggaagaugacccugggaaugugcugcauaaucacggcuaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaagcauuacaacccagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagcuacagugcuaaugggucuugggaagggauggccauugucaaaaauggacauuggaguuccccuucucgcuaucgggugcuauucacaagucaaccccauaacucucacagcagcccuucucuuauugguagcacauuaugcuaucauagggccaggacuccaggcgaaagcaacuagagaggcucagaaaagagcagcagcgggcaucaugaaaaacccaacuguggauggaauaacagugauugaccuagauccaauacccuaugauccaaaguuugaaaagcaguugggacagguaaugcucuuaguccucugcgugacucaaguauugaugaugaggacuacaugggcuuuaugugaagcucuaaccuuagcaaccgggcccaucucuacacugugggaaggaaauccagggagauuuuggaacacaacuauugcagugucaauggcuaacauuuuuagagggaguuaccuggccggagccggacuucucuuuuccaucaugaagaacacggccaacacaagaaggggaacuggcaacacaggagagacgcuuggagagaaauggaaaaaccgguugaaugcauuagggaagagugaauuccagaucuauaagaaaaguggaauccaggaaguggauagaaccuuagcaaaagaaggcaucaaaagaggagaaacggaccaucacgcugugucgcgaggcucagcgaaacugagaugguucgucgagagaaaccuggucacaccagaagggaaaguaguggaccuuggcugcggcagggggggcuggucauacuauugugggggacuaaagaauguaaaagaagucaaaggcuuaacaaaaggaggaccaggacacgaagaacccauucccaugucaacauaugguuggaaucuggugcgucuucaaaguggaguugauguuuuuuuuacuccgccagaaaagugugacacauugcugugugacauaggggagucgucaccaaaccccacgguugaagcaggacgaacacucagaguucuaaacuuaguggaaaauuggcugaacaacaacacccaauuuugcauaaagguucucaacccauacaugcccucaguuauagaaaaaauggaagcgcuacaaaggaaauacggaggagcuuuggugaggaauccacucucacgaaauuccacacaugagauguacuggguaucuaaugcuuccgggaacauagugucaucagugaacaugauuucaagaauguugauuaacagauucacaaugagacacaagaaggccacguacgagccagauguugaccucggaaguggaacccgcaacauaggaauugaaagugagacaccaaauuuagacauaauugggaaaagaauagaaaaaauaaagcaagagcaugaaacaucauggcacuaugaccaagaccacccauacaaaacgugggccuaccaugguagcuacgaaacaaaacagacuggaucagcaucauccauggugaacggagugguuaggcugcuaacaaaaccuugggacaucaucccuauggugacacagauggcaaugacagauacgacuccauuuggacaacagcgcgucuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaagcaaugcagcccuaggugccauauucacugaugagaacaaguggaagucggcacgugaggcuguugaagacaguggauuuugggaauugguugacaaggaaaggaaucuccaucuugaaggaaagugugagacauguguguauaacaugaugggaaagagagaaaagaagcuaggggaguuuggcaaagcaaaaggcagcagagccauaugguacauguggcuuggagcacgcuucuuagaauuugaagcccuaggauuccugaaugaagaucacugguuuuccagagagaacucccugaguggaguggaaggagaagggcugcacaaacuaggcuacauuuuaagagacgugaguaagaaagagggaggagcaauguaugccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcgugugcaaagaccaacaccaagaggcacaguaauggacauuauaucgagaagagaccaaagagguaguggacaaguugucaccuacggccucaauacuuucaccaacauggaagcccaacugaucagacaaauggagggagaaggagucuucaaaaguauccagcaauugacagucacagaagaaauugcagugaaaaacugguuaguaagaguggggcgugagagguuaucaagaauggccaucaguggagaugauuguguugugaaacccuuagaugacagguuugcaagcgcccuaacagcucuaaaugacaugggaaagguuaggaaagacauacaacaaugggaaccuucaagaggauggaacgauuggacacaagugcccuuuuguucacaccauuuucaugaguuaaucaugaaggacggucguguacucguagucccaugcagaaaccaagaugaacugauugguagggcccgaauuucccagggagccggauggucccugcgggaaacagccuguuuggggaagucuuacgcccaaauguggagccugauguacuuccacagacgugaccuuaggcuggcggcaaaugccauuugcucggcagucccaucacacuggguuccaacaagucgaacaaccugguccauacacgccacacaugaguggaugacaacagaagacaugcugacagucuggaacaggguguggauucaagaaaacccauggauggaagacaaaacucuaguagaaucaugggaagaaaucccauauuuggggaaaagagaagaccaauggugcggcucauugauugggcuaacaagcagggccaccugggcgaagaacauccaaacagcgauaaaucaaguuagaucccuaauaggcaaugaggaauacacagacuacaugccauccaugaaaagauucagaagagaagaggaagaggcaggagucuugugguag

SEQ ID NO: 7076 - RNA, 9876 nt, Artificial Sequence
  derived and/or modified CDS sequence (wt) from DENV-2__JN851130__SS-prME
acugcagguauaauuauuaugaugauuccaacagugauggcguuccauuuaaccacacgcaacggagaaccacacaugaucgucaguagacaagagaaagggaaaagucuucuguuuaaaacagagaacggugugaacauguguacucucauggccauggaccuuggugaacugugugaagacacaaucacuuauaauuguccucuccucaggcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacaugcccagagaauugaaacuugggucuugagacauccaggcuucaccauaauggcagcaauccuggcuuacacuauaggaacgacauauuuccaaagaguccugaucuucaucuuacugacagcugucgcuccuucaaugacaaugcguugcauaggaauaucaaauagagacuuuguggaagggguuucaggaggaagcuggguugacauagucuuggaacauggaagcugugugacgacgauggcgaaaaauaaaccaacauuggauuuugaacugauaaaaacagaagccaaacaccccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaagggagguaucgugaccugugcaauguucacaugcaaaaagaacauggaagggaaaauugugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuaugguacuguuacgauggaaugcucuccgagaacgggccucgacuucaaugagaugguguugcugcaaauggaaaacaaggcuuggcuggugcacaggcaaugguucuuagaccugccguuaccauggcugcccggagcagacacacaaggaucaaauuggauacagaaggagacauuggucacuuucaaaaauccccaugcaaagaaacaggauguugucguuuuaggaucccaagaaggggcuaugcacacagcacucacaggggccacggaaauccagaugucaucaggaaacuuacuguucacuggacaucuuaagugcaggcugagaauggacaaacuacagcucaaaggaaugucauauuccauguguacaggaaaguuuaaaguugugaaggaaauagcagaaacacaacauggaacaauaguuaucagaguacaauaugaaggggacgguucuccguguaagaucccuuuugaaauaauggauuuggaaaaaagacauguccuaggucgcuugauuacagucaacccaauugucacagaaaaagacagcccagucaacauagaagcagaaccuccauucggggacagcuacaucauuauaggaguagaaccaggacaacugaagcucagcugguuuaagaaaggaaguucuauuggccaaauguuugagacaacaaugagaggagcgaagagaauggccauuuuaggugacacagcuugggauuuuggauccuugggagggguguucacauccauaggaaaggcccuccaccaagucuuuggagcaaucuauggggcugccuucagugggguuucauggacuaugaaaauccucauaggagucgucaucacauggauaggaaugaauucacgcagcacuucacugucugugucacuaguauuagugggggucgugacauuguauuugggaguuauggugcaggccgauagugguugcguugugaguuggaaaaacaaagaacugaaauguggcagugggauuuuuaucacagacaacguacacacauggacagaacaauacaaauuccaaccagaauccccuucaaagcuggccucagcuauccagaaggcucaugaagaaggcauuuguggaauccgcucaguaacaagacuggagaaucugauguggaaacaaauaacaccagaacugaaucacauucuaucagaaaaugaggugaaguugacuaucaugacaggagacauuaaaggaaucaugcaggcaggaaaacgaucccugcggccucaacccacugagcugaaguacucuuggaaaacauggggcaaagcgaaaaugcucuccacagagcuucacaaccacaccuuucucauugauggccccgaaacagcagaaugucccaacacaaacagagcuuggaacucacuagaagucgaagacuauggcuuuggaguauucaccaccaacauauggcugaaauugaaagaaaggcaggauguauuuugugacucaaaacucaugucagcagccauaaaagauaacagagccguccacgccgauauggguuauuggauagaaagcgcacucaaugacacauggaagauugagaaagccucuuuuauugaaguuaaaagcugcuacuggccaaagucacacacccucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaaccacagugguggugacugaggacuguggaaauagaggacccucuuuaagaacaacuacugcuucuggaaaacucauaacagaguggugcugccgaucuugcacauuaccaccacuaagguacagaggugaggauggaugcugguauggaauggaaauuagaccacugaaagagaaagaagagaacuuggucaacucuuuggucacagccggacauggacagauugacaacuucucacuaggagucuugggaauggcacuguuccuggaagagaugcucaggacccgaguaggaacgaaacaugcaauauuacuaguugcaguuucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuuugcagcuggauuacucuuaagaaagcugaccuccaaggaauugaugaugaccaccauaggaaucgugcuccucucccagagcaccauaccagagacuauacuugaacugacugacgcauuggcuuuggggaugauggcucucaaaauagugagaaacauggaaaaguaucaacuagcagugacuaucauggccaucuugugcgucccaaaugcagugauauuacaaaacgcauggaaagugagcugcacaacacuggcagugguguccguuuccccacugcuuuuaacauccucacagcagaaagcggauuggauaccacuggcguugacgaucaaaggccuuaauccaacagccauuuucuuaacaacccucucaagaacuagcaagaaaaggagcuggccacuaaaugaggcuauuauggcagucgggauggugagcauuuuagccaguucucucuuaaagaacgauauucccaugacaggaccauuaguggcuggagggcuucucacuguguguuacguacucacuggaagaucggcugauuuggaacuggagagagcugcugacguaagaugggaagaacaggcagagauaucaggaaguaguccaauucugucgauaacaauaucggaagaugguagcaugucgauaaaaaaugaagaagaagaacaaacacugaccauacucaucagaacaggacuguuagugauaucaggacuuuuucccgugucaauaccaaucacggcagcugcaugguaccugugggaagugaaaaaacaacgagcaggaguauugugggauguccccucacccccaccugugggaaaggccgaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaagaaggagaagaaguccagguccuggcauuagagccuggaaagaauccaagagcuguccaaacaaaacccggucuuuuuaaaacuaacacuggaaccauaggcgccgugucucuggacuuuucuccuggaacgucaggaucuccaaucgucgacaaaaaaggaaaaguugugggccuuuauggcaacggugucguuacaaggaguggaacauaugugagugcuauagcccagacugaaaaaagcaucgaagacaauccagagauugaagaugacaucuuucgaaagaaaagauugaccaucauggaccuccacccaggagcagggaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaaguagagauccauuuccucagagcaaugcaccaaucauggaugaagaaagggaaaucccugagcguucguggaacucuggacaugaauggguuacggauuuuaaagggaagacuguuugguuuguuccaagcauaaaagcagggaaugauauagcagcuugccugagaaagaauggaaagaaagugauacaacucagcaggaagacuuuugauucugaauauauuaagacuaggaccaaugauugggacuuuguggucacgacagacauuucagaaaugggugcaaacuucaaggcugagaggguuauagaccccagacgcuguaugaaaccagucauacuaacagacggugaagagcgggugaucuuggcaggacccaugccagugacccacucuagugcagcacaaagaagagggagaguaggaagaaauccaaaaaaugaaaaugaccaguacauauacaugggggaaccucuggaaaaugaugaagacugugcacacuggaaagaagcuaaaaugcuucuagacaacaucaacacgccugaaggaaucauucccagcauguucgaaccagagcgugaaaagguggaugccauugauggugaauaccgcuugagaggagaagcaagaaaaacuuuuguggaccuaaugagaagaggagaccuaccagucugguuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauugaaacccagaugguuggaugcuaggaucuacucugacccacuggcgcucaaagaauucaaggaauucgcagcuggaagaaagucccugacccugaaucuaaucacagagauggguaggcucccaaccuucaugacccagaaagcaaggaaugcacuggacaacuuagcagucuugcauacagcugaagcaggcggaagggcguacaaccaugcucuuagugaacugccggagacucuggagacauugcuuuuacugacacucuuggccacagucacgggcggaaucuuccuguucuugaugaguggaaaggguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaaugagauggguuuccuggaaaaaacaaagaaagauuucggauugggaagcauuacaacccagcaaccugagagcaauauccuggacauagaucuacguccugcaucagcuuggacucuauaugccguggcaacaacuuucaucacaccaaugcugagacauagcauugaaaauuccucagugaaugugucucuaacagccauugccaaccaagccacaguguuaaugggucuugggaaaggauggccauugucaaaaauggacaucggaguuccccuucucgcuaucgggugcuauucacaagucaaccccauaacucucacagcagcccuucucuuauugguagcacauuaugcuaucauagggccaggacuccaagcgaaagcaacuagagaggcucaaaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcaaccgggcccaucucuacacugugggaaggaaauccaggaagauucuggaauacaacuauugcagugucaauggcuaacauuuuuagagggaguuacuuggccggagccggacuucucuuuucuaucaugaagaacacggcuaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacagaccaucacgcugugucgcgaggcucggcgaaacugagaugguucgucgagagaaaccuggucacaccagaagggaaaguaguggaccuugguugcggcagggggggcuggucauacuauugugggggacuaaagaauguaaaagaagucaaaggccuaacaaaaggaggaccaggacacgaagaacccauucccaugucaacauaugguuggaaucuggugcgucuucaaaguggaguugauguuuuuuucacuccgccagaaaagugugauacauugcugugugacauaggggagucgucaccaaaccccacgguugaagcaggacgaacacucagaguucuaaacuuaguggaaaauuggcugaacaacaacacccaauuuugcauaaagguucucaacccauauaugcccucaguuauagaaaaaauggaagcacuacaaaggaaauacggaggagcuuuggugaggaauccacucucacgaaauuccacacacgagauguacuggguauccaaugcuuccgggaacauagugucaucagugaauaugauuucaagaauguugauuaacagauucacaaugagacacaagaaggccacauacgagccagauguugaccucggaaguggaacccgcaacaucggaauugaaagugagauaccaaauuuagacauaauugggaaaagaauagaaaaaauaaaacaagagcaugaaacaucauggcauuaugaccaagaucacccauacaaaacgugggccuaucauggcagcuacgaaacaaaacagacuggaucagcaucauccauggugaacggagugguuagguugcuaacaaaaccuugggacguuaucccuauggugacacagauggcaaugacagauacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagagaagaauucacaagaaaggugagaaguaaugcagccuuaggcgccauauucacugaugagaacaaguggaagucggcacgugaggcuguugaagacaguggauuuugggaauugguugacaaggaaaggaaucuccaucuugaaggaaagugugagacauguguauauaacaugaugggaaagagagagaagaagcuaggggaguucggcaaagcgaaaggcagcagagcuauaugguacauguggcuuggagcacgcuucuuagaguuugaagcccuaggauucuugaacgaagaucacugguuuuccagagagaacucccugaguggaguggaaggagaagggcugcacaaacuaggcuacauuuuaagagacgugaguaagaaagaaggaggagcaauguacgcugaugacaccgcaggaugggacacaagaaucacauuagaggacuuaaaaaaugaagaaauggugacaaaccacauggaaggagaacacaagaaacuugcugaagccaucuucaaauuaacguaccaaaacaagguggugcgugugcaaagaccaacgccaagaggcacaguaauggacauuauaucgagaagagaccaaagagguagcggacaaguugucaccuacggccucaauacuuucaccaacauggaagcccaacugaucagacagauggagggagaaggagucuucaaaagcauccagcaauugacagucacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacaacaaugggaaccuucaagaggauggaacgauuggacacaagugccuuuuuguucacaccauuuccaugaguuaaucaugaaggacggucguguacucguaguuccaugcagaaaucaagaugaacugauugguagggcccgaauuucccagggagccgggugguccuugcgggaaacagccuguuuggggaagucuuacgcccaaauguggagccugauguacuuccacagacgugaccuuaggcuggcagcaaaugccauuugcucggcagucccaucacauuggguuccaacaagucgaacaaccugguccauacacgccacacaugaguggaugacaacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaagaggaagaggcaggagucuugugguag

SEQ ID NO: 7077 - RNA, 9876 nt, Artificial Sequence
  derived and/or modified CDS sequence (wt) from DENV-2__JN851125__SS-prME
accgcagguauaauuauuaugaugauuccaacagugauggcguuccauuuaaccacacgcaacggagaaccacacaugaucgucaguagacaagagaaaggaaaaagucuucuguuuaaaacagagaacggugugaacaugugcacccucauggccauggaccuuggugaacugugugaagacacaaucacuuauaauuguccucuucucaagcagaaugaaccagaagacauagacuguuggugcaacucuacgucuacauggguaacuuaugggacaugcaccgccacaggagaacacagaagggaaaaaagaucaguggcacucguuccacaugugggaaugggacuggagacacgaacugaaacauggaugucaucagaaggggccuggaaacacgcccagagaauugaaacuugggucuugagacauccaggcuucaccguaauggcagcaauccuggcauacaccauaggaacgacauauuuccaaagaguccugauuuucaucuugcugacagcugucgcuccuucaaugacaaugcguuguauaggaauaucaaauagagacuuuguggaagggguuucaggaggaagcuggguugacauagucuuggaacauggaagcugugugacgacgauggcgaagaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagacagaggauggggaaauggaugcggauuauuuggaaaaggaggcaucgugaccugugcaauguucacauguaaaaagaacauggaaggaaaagucgugcaaccagaaaauuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggucucgacuucaaugagaugguguugcugcaaauggaaaacaaagcuuggcuggugcacaggcaaugguucuuagaccugccguuaccauggcugcccggagcagacacacaaggaucaaacuggauacagaaggagacauuggucacuuucaaaaauccccaugcaaagaaacaggauguuguuguuuuaggaucccaagaaggggcuaugcauacagcacucacaggggccacggaaauccagaugucgucaggaaacuuacuguucacaggacaucuuaagugcagguugagaauggacaaacuacagcucaaaggaaugucauauuccauguguacaggaaaguuuaaaguugugaaggaaauagcagaaacacaacauggaacaauaguuaucagaguacaauaugaaggggacgguucuccgugcaagaucccuuuugaaauaauggacuuggaaaaaagacaugucuuaggucgccugauuacagucaacccaauugucacagaaaaagacagcccagucaacauagaagcagaaccuccauucggagacagcuauaucauuauaggaguagaaccgggacaacugaagcucagcugguuuaagaaaggaaguucuauuggccaaauguuugagacaacaaugagaggagcgaagagaauggccauuuuaggugacacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacguagcaccucacugucugugucauuaguauuagugggggucgugacacuguauuugggaguuauggugcaggccgauagugguuguguugugaguuggaaaaacaaagaacugaaauguggcagugggauuuuuauuacagacaacgugcacacauggacagaacaauacaaauuccaaccagaauccccuucaaagcuggcuucagcuauucagaaggcucaugaagaaggcauuuguggaauccgcucaguaacaagacuggagaaucugauguggaaacaaauaacaccagaacugaaucacauucuaucagaaaaugagguaaagaugacuaucaugacaggagacauuaaaggaauuaugcaggcaggaaaacgaucccugcggccucaacccacugagcugaaguacucuuggaaagcauggggcaaagcgaaaaugcucuccacagaacuucauaaccacaccuuucucauugauggccccgaaacagcagaaugucccaacacaaacagagcuuggaacucacuagaaguugaagacuauggcuuuggaguauucaccacuaacauauggcugaaauugaaagaaaggcaggauguaucuugugacucaaaacucaugucagcagccauaaaggacaacagagccguccacgccgacauggguuauuggauagaaagcgcacucaaugacacauggaagauugagaaagccucuuucauugaaguuaaaagcugccacuggccaaagucacacacccucuggaguaauggagugcuagaaagugagaugauaauuccaaagaauuuugcaggaccaguaucacaacacaauuauagaccaggcuaucauacacaaacggcaggacccuggcaucuagguaggcuugagauggacuuugauuucugcgaaggaaccacagugguggugacugaggacuguggaaauagaggacccucuuuaagaacaaccacugcuucuggaaaacucauaacagaguggugcugccgaucuugcacauuaccaccacuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcaguuucuuucgugacauugaucacagggaacauguccuuucgagauuuggggagagugauggucauggugggcgcuaccaugacggaugacauaggcaugggcgugacuuaucuugcccuauuagcagccuucaaagucagaccaacuuuugcagcuggacuacucuuaagaaagcugaccuccaaggaauugaugaugaccaccauaggaaucguacuccucucccagagcaccauaccagagacuauacuugaacugacugacgcguuggcuuuagggaugaugguucuuaaaguagugagaaacauggaaaaguaccaacuagcagugacuaucauggccaucuugugcgucccaaaugcagugauauuacaaaacgcauggaaagugagcugcacaacacuggcagugguguccguuuucccacugcuuuuaacauccucacagcagaaagcggauuggauaccacuggcguugacgaucaaaggccucaauccaacagccauuuucuuaacaacccucucaagaacuagcaagaaaaggagcuggccacuaaacgaggcuauuauggcagucgggauggugagcauuuuagccaguucucucuuaaaaaaugauauucccaugacaggaccauuaguggcuggagggcuucucacuguguguuacgugcucacuggaagaucggcugauuuggaacuggagagagcugcugacguaagaugggaagaacaagcagagauaucaggaaguaguccaauucugucgauaacaauaucggaagaugguagcaugucgauaaaaaaugaagaagaagaacaaacacugaccauacucauuagaacaggacugcuggugauaucaggacuuuuucccgugucaauaccaaucacggcagcugcaugguaccugugggaagugaaaaaacaacgagcaggaguauugugggaugucccuucacccccaccugugggaaaggcugaacuggaagauggagccuauagaaucaagcagaaagggauucuaggauacucgcagaucggagccggaguuuacaaagaaggaacauuccacacaauguggcaugucacacguggugcuguccuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggcgccgugucucuggacuuuucuccuggaacgucaggaucuccaaucgucgacaaaaaaggaaaaguugugggccuuuaugguaacggugucgucacaaggaguggaacauaugugagugccauagcccagacugaaaaaagcaucgaagacaauccagagauugaagaugacaucuuucgaaagaaaagauugaccaucauggaccuucacccaggagcaggaaaaacaaagagauaccuuccagcaauagucagagaagccauaaaacgaggcuugagaacacuaauccuggcccccacuagaguuguggcggcugaaauggaagaagcucucagaggacuuccaauaagauaccaaaccccagcuaucagagcugagcacacugggcgggagauuguggaucuaaugugucacgccacauuuaccaugaggcuacuaucaccaauuagagugccaaauuacaaccugauuaucauggaugaagcccauuucacagacccagcaagcauagcagcuagaggauacauuucaacucgaguagagaugggugaagcagcugggauuuuuaugacagcuacccccccaggaagcagagacccauuuccucagagcaaugcaccaaucauggaugaagaaagggaaaucccugagcguucguggaacucuggacaugagugggucacggauuuuaaagggaagacuguuugguuuguuccaaguauaaaagcagggaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggccgagaggguuauagaccccagacgcugcaugaaaccaguaauacuaacagauggugaagagcggguaaucuuggcaggacccaugccagugacccacucuagugcagcacaaagaagagggagaguaggaagaaauccaaaaaaugaaagugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggacgccauugauggugaauaccgcuugagaggagaagcgaggaaaacuuucguggaccuaaugagaagaggagaccuaccagucuggcuagccuacagaguggcagcugaagguaucaacuacgcagacagaagauggugcuuugauggagucaagaacaaccaaaucuuggaagaaaauguggaaguggaaauuuggacaaaagaaggagaaaggaagaaauuaaaacccagaugguuggaugcuaggaucuauucugacccacuggcgcucaaagaauucaaggaauucgcagcuggaagaaagucccugacccugaaucuaaucacagagauggguaggcucccaaccuucaugacccagaaagcaaggaaugcacuggacaacuuagcagucuugcacacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaauguguugcauaaucacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguagcugcaaccauggcaaacgagauggguuuccuggaaaaaacaaagaaagauuuuggauugggaagcaguacaacccagcaacaugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccccuucucgccaucgggugcuauucacaagucaaccccauaacucucacagcagcccuucucucauugguagcacauuaugccaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcagcugggacaaguaaugcucuuaguccucugcgugacucaaguguugaugaugaggacuacaugggcuuuaugugaagcucuaaccuuagcaaccgggcccaucucuacacugugggaaggaaauccagggagauuuuggaauacaacuauugcagugucaauggcuaacauuuuuagagggaguuaccuggccggagccggacuucucuucucuaucaugaagaacacggccaacacaagaaggggaacuggcaacacaggagagacgcuuggagagaaauggaaaaaccgguugaaugcauuggggaagagugaauuccagaucuauaagaaaaguggaauccaggaaguggauagaaccuuagcaaaagaaggcaucaaaagaggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaaccuauucccaugucaacauacgguuggaaucuggugcgucuucaaaguggaguugauguuuuuuuuacuccgccagaaaagugugacacauugcugugugacauaggggagucaucaccaaaccccacgguugaggcaggaagaacacucagaguucuaaacuuaguggaaaauuggcugaacaacaacacccaauuuugcauaaagguucucaacccauauaugcccucaguuauagaaaaaauggaagcgcuacaaaggaaauacggaggagcuuuggugagaaauccacucucacgaaauuccacacacgagauguacuggguauccaaugcuuccgggaacauagugucaucagugaacaugauuucaagaauguuaauuaacagauucacaaugagacacaagaaggccacauacgagccagauguugaccucggaaguggaacucgcaauaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggaugucauccccauggugacacagauggcaaugacagacacgacuccauuuggacaacagcgcguuuucaaagagaagguggacacgagaacccaagaaccgaaagaaggcacgaaaaagcuaaugaaaaucacggcagaauggcucuggaaagaacuaggaaagaaaaagacaccuaggaugugcaccagagaagaauucacaagaaaggugagaagcaaugcagccuuaggugccauauucacugaugagaacaaguggaagucggcacgugaggcuguugaagacaguggauuuugggaguugguugacaaggaaaggaaucuccaucuugaaggaaagugugagacauguguguacaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagagagaacucccugaguggaguggaaggagaagggcugcacaaacuaggcuacauuuuaagagacgugaguaagaaagaaggaggagcaauguacgccgaugacaccgcaggaugggacacaagaaucacacuagaggacuuaaaaaaugaagaaauggugacaaaccacauggaaggagaacacaagaaacuugcugaagccauuuucaaauuaacguaccaaaacaagguggugcguguacaaagaccaacaccaagaggcacaguaauggacauuauaucgagaagagaccaaagagguaguggacaaguugucacuuauggccucaauacuuucaccaacauggaagcccaacugaucagacagauggagggagaaggagucuucaaaagcauccagcaacugacagccacagaagaaauugcagugaaaaacugguuaguaagaguggggcgugagagguuaucaagaauggccaucaguggagaugauuguguugugaaacccuuagaugacagguuugcaagcgcucuaacagcucuaaaugacaugggaaagguuaggaaagacauacagcaaugggaaccuucaagaggauggaacgauuggacacaagugcccuuuuguucacaccauuuccaugaguuaaucaugaaggacggucguguacucguaguuccaugcagaaaccaagaugaacugauugguagggcccgaauuucccagggagccgggugguccuugcgggaaacagccuguuuggggaagucuuacgcccaaauguggagccugauguacuuccacagacgcgaucuuaggcuggcggcaaaugccauuugcucggcagucccaucacacuggguuccaacaagucgaacaaccugguccauacacgccacacaugaguggaugacaacagaagacaugcugacagucuggaacaggguguggauccaagaaaacccauggauggaagacaagacuccaguagaaucaugggaggaaaucccguauuuggggaaaagagaagaccaauggugcggcucauugauugggcuaacaagcagggccaccugggcaaagaacauccaaacagcaauaaaucaaguuagaucccuaauaggcaaugaggaauacacagacuacaugccauccaugaaaagauuuagaagagaagaggaagaggcaggagucuugugguag
